US012527250B2

(12) United States Patent
Cannon et al.

(10) Patent No.: US 12,527,250 B2
(45) Date of Patent: Jan. 20, 2026

(54) METHODS FOR IMPROVED HYBRID CORN SEED PRODUCTION

(71) Applicant: MONSANTO TECHNOLOGY LLC, St. Louis, MO (US)

(72) Inventors: Paul Cannon, Chesterfield, MO (US); Edward J. Cargill, Chesterfield, MO (US); Charles T. Foresman, St. Louis, MO (US); Michael A. Hall, Wildwood, MO (US); Scott C. Johnson, Wildwood, MO (US); John A. Miklos, Des Peres, MO (US)

(73) Assignee: MONSANTO TECHNOLOGY LLC, St. Louis, MO (US)

( * ) Notice: Subject to any disclaimer, the term of this patent is extended or adjusted under 35 U.S.C. 154(b) by 917 days.

(21) Appl. No.: 17/530,873

(22) Filed: Nov. 19, 2021

(65) Prior Publication Data

US 2022/0159919 A1 May 26, 2022

Related U.S. Application Data

(60) Provisional application No. 63/180,344, filed on Apr. 27, 2021, provisional application No. 63/125,752, filed on Dec. 15, 2020, provisional application No. 63/117,247, filed on Nov. 23, 2020, provisional application No. 63/117,237, filed on Nov. 23, 2020, provisional application No. 63/117,225, filed on Nov. 23, 2020, provisional application No. 63/117,231, filed on Nov. 23, 2020.

(51) Int. Cl.

| | |
|---|---|
| ***A01C 21/00*** | (2006.01) |
| ***A01D 91/04*** | (2006.01) |
| ***A01G 22/20*** | (2018.01) |
| ***A01H 6/46*** | (2018.01) |
| ***C07K 14/415*** | (2006.01) |
| ***C12N 15/82*** | (2006.01) |

(52) U.S. Cl.

CPC .............. *A01C 21/00* (2013.01); *A01D 91/04* (2013.01); *A01G 22/20* (2018.02); *A01H 6/4684* (2018.05); *C07K 14/415* (2013.01); *C12N 15/8218* (2013.01); *C12N 15/8262* (2013.01); *C12N 15/8297* (2013.01); *C12Y 114/11012* (2013.01)

(58) Field of Classification Search

None

See application file for complete search history.

(56) References Cited

U.S. PATENT DOCUMENTS

| | | | |
|---|---|---|---|
| 4,368,592 | A | 1/1983 | Welch |
| 5,159,135 | A | 10/1992 | Umbeck |
| 5,188,958 | A | 2/1993 | Moloney et al. |
| 5,322,938 | A | 6/1994 | McPherson et al. |
| 5,352,605 | A | 10/1994 | Fraley et al. |
| 5,463,174 | A | 10/1995 | Moloney et al. |
| 5,510,474 | A | 4/1996 | Quail et al. |
| 5,538,880 | A | 7/1996 | Lundquist et al. |
| 5,550,318 | A | 8/1996 | Adams et al. |
| 5,591,616 | A | 1/1997 | Hiei et al. |
| 5,641,876 | A | 6/1997 | McElroy et al. |
| 5,750,871 | A | 5/1998 | Moloney et al. |
| 5,824,877 | A | 10/1998 | Hinchee et al. |
| 5,850,019 | A | 12/1998 | Maiti et al. |
| 5,939,539 | A | 8/1999 | Lange et al. |
| 6,153,812 | A | 11/2000 | Fry et al. |
| 6,160,208 | A | 12/2000 | Lundquist et al. |
| 6,198,021 | B1 | 3/2001 | Lange et al. |
| 6,372,211 | B1 | 4/2002 | Isaac et al. |
| 6,380,467 | B1 | 4/2002 | Duclos |
| 6,384,301 | B1 | 5/2002 | Martinell et al. |
| 6,399,861 | B1 | 6/2002 | Anderson et al. |
| 6,420,547 | B1 | 7/2002 | Maiti et al. |
| 6,429,357 | B1 | 8/2002 | McElroy et al. |
| 6,723,897 | B2 | 4/2004 | Brown et al. |
| 6,765,133 | B2 | 7/2004 | Koehring |
| 7,041,874 | B2 | 5/2006 | Johal et al. |
| 7,049,490 | B2 | 5/2006 | Tanaka et al. |
| 7,057,088 | B2 | 6/2006 | Tanaka et al. |
| 7,138,567 | B2 | 11/2006 | Okawa et al. |
| 7,154,028 | B2 | 12/2006 | Tanaka et al. |
| 7,597,055 | B2 | 10/2009 | Choulet |
| 8,835,353 | B2 | 9/2014 | Fugiel et al. |
| 9,012,722 | B2 | 4/2015 | Narva et al. |
| 9,040,774 | B2 | 5/2015 | Ivashuta et al. |

(Continued)

FOREIGN PATENT DOCUMENTS

| | | | |
|---|---|---|---|
| AU | 2016203359 | B2 | 3/2018 |
| CN | 101440374 | A | 5/2009 |

(Continued)

OTHER PUBLICATIONS

Song et al. (2011) 482:34-42.*

(Continued)

*Primary Examiner* — Russell T Boggs

(74) *Attorney, Agent, or Firm* — Dentons US LLP; David Lanzotti

(57) ABSTRACT

Methods for improving the efficiency and productivity of hybrid corn seed production are provided herein. Various methods to improve the transfer of pollen from male corn plants to female corn plants, and thus increase yield, are provided herein. Without being limiting, these methods include varying the height of male and female corn plants in a field, as well as varying the number, arrangement, and ratio of male-to-female rows in a field.

18 Claims, 12 Drawing Sheets

Specification includes a Sequence Listing.

(56) References Cited

U.S. PATENT DOCUMENTS

| | | | |
|---|---|---|---|
| 9,303,919 | B2 | 4/2016 | Hultgren et al. |
| 9,309,512 | B2 | 4/2016 | Allen et al. |
| 9,845,479 | B2 | 12/2017 | Beghyn et al. |
| 10,123,473 | B2 | 11/2018 | Cavender-Bares et al. |
| 10,472,684 | B2 | 11/2019 | Barten et al. |
| 10,724,047 | B2 | 7/2020 | Allen et al. |
| 10,881,057 | B2 | 1/2021 | Cannon et al. |
| 11,627,736 | B2 | 4/2023 | Barten et al. |
| 11,632,921 | B2 | 4/2023 | Cannon et al. |
| 12,274,205 | B2 | 4/2025 | Barten et al. |
| 2002/0053095 | A1 | 5/2002 | Brown et al. |
| 2002/0162142 | A1 | 10/2002 | Johal et al. |
| 2003/0172409 | A1 | 9/2003 | Horn |
| 2003/0233679 | A1 | 12/2003 | Brown et al. |
| 2004/0053411 | A1 | 3/2004 | Cullen et al. |
| 2004/0121321 | A1 | 6/2004 | Brown et al. |
| 2004/0268441 | A1 | 12/2004 | Vance et al. |
| 2005/0037988 | A1 | 2/2005 | Zamore et al. |
| 2005/0064474 | A1 | 3/2005 | Umov et al. |
| 2005/0144669 | A1 | 6/2005 | Reinhart et al. |
| 2005/0197253 | A1 | 9/2005 | Stoller et al. |
| 2005/0251883 | A1 | 11/2005 | Amasino et al. |
| 2006/0200878 | A1 | 9/2006 | Lutfiyya et al. |
| 2006/0253933 | A1 | 11/2006 | Brown et al. |
| 2007/0174931 | A1 | 7/2007 | Brown et al. |
| 2007/0294789 | A1 | 12/2007 | Ghiglione et al. |
| 2008/0034453 | A1 | 2/2008 | Cheikh et al. |
| 2009/0031441 | A1 | 1/2009 | Matsuoka et al. |
| 2009/0070898 | A1 | 3/2009 | Allen et al. |
| 2009/0117617 | A1 | 5/2009 | Holmes et al. |
| 2009/0313725 | A1 | 12/2009 | Yu et al. |
| 2010/0095406 | A1 | 4/2010 | Yu et al. |
| 2010/0107283 | A1 | 4/2010 | Dasgupta et al. |
| 2011/0004958 | A1 | 1/2011 | Aloni et al. |
| 2011/0035839 | A1 | 2/2011 | Lutfiyya et al. |
| 2011/0126310 | A1 | 5/2011 | Feng et al. |
| 2011/0145940 | A1 | 6/2011 | Voytas et al. |
| 2011/0167517 | A1 | 7/2011 | Danilevskaya et al. |
| 2011/0185456 | A1 | 7/2011 | Cheikh et al. |
| 2011/0296555 | A1 | 12/2011 | Ivashuta et al. |
| 2011/0301073 | A1 | 12/2011 | Gregory et al. |
| 2012/0142062 | A1 | 6/2012 | Doyon et al. |
| 2012/0174260 | A1 | 7/2012 | Narva et al. |
| 2012/0216318 | A1 | 8/2012 | La Rosa et al. |
| 2012/0297501 | A1 | 11/2012 | Beghyn et al. |
| 2013/0117869 | A1 | 5/2013 | Duchateau et al. |
| 2013/0121101 | A1 | 5/2013 | Ochampaugh et al. |
| 2013/0260012 | A1 | 10/2013 | Rommens et al. |
| 2013/0283461 | A1 | 10/2013 | Abad et al. |
| 2013/0345937 | A1 | 12/2013 | Strelioff et al. |
| 2014/0013464 | A1 | 1/2014 | Davie |
| 2014/0074360 | A1 | 3/2014 | Rosa et al. |
| 2014/0165228 | A1 | 6/2014 | Danilevskaya et al. |
| 2014/0344996 | A1 | 11/2014 | Inze et al. |
| 2015/0052634 | A1 | 2/2015 | Park et al. |
| 2015/0201619 | A1 | 7/2015 | Annigeri et al. |
| 2015/0247154 | A1 | 9/2015 | Ivashuta et al. |
| 2015/0307889 | A1 | 10/2015 | Petolino et al. |
| 2015/0376641 | A1 | 12/2015 | Etzioni et al. |
| 2016/0010109 | A1 | 1/2016 | Albertsen et al. |
| 2016/0017349 | A1 | 1/2016 | Ayele et al. |
| 2016/0046956 | A1 | 2/2016 | Yu et al. |
| 2016/0050865 | A1 | 2/2016 | Morse et al. |
| 2016/0050920 | A1 | 2/2016 | Ott et al. |
| 2016/0076046 | A1 | 3/2016 | Alexandrov et al. |
| 2016/0319375 | A1 | 11/2016 | Barten et al. |
| 2017/0079224 | A1 | 3/2017 | Jolliffe et al. |
| 2018/0051295 | A1 | 2/2018 | Allen et al. |
| 2019/0014730 | A1 | 1/2019 | Dong et al. |
| 2019/0014731 | A1 | 1/2019 | Ovadya et al. |
| 2019/0241903 | A1 | 8/2019 | Ellis et al. |
| 2019/0246586 | A1 | 8/2019 | Cannon et al. |
| 2019/0246619 | A1 | 8/2019 | Barten et al. |
| 2020/0140874 | A1 | 5/2020 | Barten et al. |
| 2021/0032649 | A1 | 2/2021 | Manjunath et al. |
| 2022/0039320 | A1 | 2/2022 | Barten et al. |
| 2022/0159905 | A1 | 5/2022 | Barten et al. |
| 2022/0162632 | A1 | 5/2022 | Barten et al. |
| 2022/0364108 | A1 | 11/2022 | Allen et al. |
| 2023/0110884 | A1 | 4/2023 | Allen et al. |
| 2023/0292733 | A1 | 9/2023 | Barten et al. |
| 2023/0323381 | A1 | 10/2023 | Cannon et al. |
| 2025/0221340 | A1 | 7/2025 | Barten et al. |
| 2025/0277194 | A1 | 9/2025 | Allen et al. |

FOREIGN PATENT DOCUMENTS

| | | | |
|---|---|---|---|
| CN | 102149821 | A | 8/2011 |
| CN | 102174519 | A | 9/2011 |
| CN | 111778265 | | 10/2020 |
| EP | 1398382 | B1 | 11/2005 |
| JP | 3829157 | B2 | 10/2006 |
| KR | 20150045611 | A | 4/2015 |
| RU | 2013135491 | A | 2/2015 |
| RU | 2013151447 | A | 5/2015 |
| WO | WO 94/28141 | A1 | 12/1994 |
| WO | WO 99/09174 | A1 | 2/1999 |
| WO | WO 99/66029 | A2 | 12/1999 |
| WO | WO 00/009722 | A2 | 2/2000 |
| WO | WO 02/055725 | A2 | 7/2002 |
| WO | WO 03/008540 | A2 | 1/2003 |
| WO | WO 2004/092390 | | 10/2004 |
| WO | WO 2006/032916 | A2 | 3/2006 |
| WO | WO 2007/134234 | | 11/2007 |
| WO | WO 2008/034648 | A1 | 3/2008 |
| WO | WO 2010/002984 | A1 | 1/2010 |
| WO | WO 2011/023537 | A1 | 3/2011 |
| WO | WO 2013/037959 | A1 | 3/2013 |
| WO | WO 2013/086499 | A2 | 6/2013 |
| WO | WO 2014/055477 | A2 | 4/2014 |
| WO | WO 2014/151749 | A1 | 9/2014 |
| WO | WO 2015/168124 | A1 | 11/2015 |
| WO | 2016/176286 | | 11/2016 |
| WO | WO 2017/011791 | | 1/2017 |
| WO | 2018/035354 | | 2/2018 |
| WO | 2018/119225 | | 6/2018 |
| WO | 2018/129302 | | 7/2018 |
| WO | 2019/161143 | | 8/2019 |
| WO | 2019/161145 | | 8/2019 |
| WO | 2019/161149 | | 8/2019 |

OTHER PUBLICATIONS

Zhang et al. (2019) BMC Plant Biol 19:589.*
Köllner et al. (2010) 153:1795-807.*
Pilu et al. (2007) Mol Breed 20:83-91.*
Multani et al. GenBank AY36605 (2003).*
Reynolds et al. (2004) Nature Biotech 22(3):326-30.*
Thomas et al. (2001) Plant J 25:417-25.*
Klahre et al. (2002) Proc Natl Acad Sci 99:11981-86, 11983-84.*
Haegele et al. (2014) Agron J 106(5):1838-46.*
MacRobert et al. (2014) "Maize Hybrid Seed Production Manual," CIMMYT.*
Guo et al. (2004) Proc Natl Acad Sci USA 101:9205-10.*
BLAST® NCBI's website Seq ID No. 180 (Jul. 26, 2025).*
Chen, et al. "Development of dwarfish and yield-effective GM maize through passivation of bioactive gibberellin." Transgenic Res, 28:589-599, (2019).
Bage et al., Genetic characterization of novel and CRISPR-Cas9 gene edited maize brachytic 2 alleles, Plant Gene 21:100198, 2020.
Bolduc and Hake, The maize transcription factor KNOTTED1 directly regulates the gibberellin catabolismgene ga2ox1, Plant Cell 21:1647-1658, 2009.
R4038-sprayer by John Deere, available at https://kibbleeq.com/farmers/sprayers-&-applicators/self-propelled-sprayers/john-deere-sprayers/r4038-sprayer, accessed Apr. 29, 2024.
Sun et al., Identification and characterization of El (Elongated Internode) gene in tomato (*Solanum lycopersicum*), Int. J. Mol. Sci. 20(2204):1-18, 2019.
Abendroth & Elmore, presentation titled "Corn Growth and Development" available at https://www.ipm.iastate.edu/files/curriculum/

(56) References Cited

OTHER PUBLICATIONS

03%20Corn%20Growth%20and%20Development_0.pdf, accessed Feb. 12, 2025.
Jayasundara et al., Energy and Greenhouse Gas Intensity of Corn (*Zea mays* L.) Production in Ontario: a Regional Assessment, Can J. Soil Sci. 94:77-95, 2014.
Lindsey & Zoller, Useful Tables: Adjustments and Conversions on Corn and Soybean Parameters, article on the Ohio State University Extension website https://ohioline.osu.edu/factsheet/agf-502, 2018.
Nielsen, Short Corn at Tasseling, article for Purdue Agronomy available at https://www.agry.purdue.edu/ext/corn/ news/articles.01/short_corn-0712.html, 2001.
Cox, W. et al., "Row Spacing, Hybrid, and Plant Density Effects on Corn Silage Yield and Quality"; J. Prod. Agic., vol. 11, No. 1, 1998.
Pendleton, J. et al., "Plant Population and Row Spacing Studies with brachytic 2 Dwarf Corn"; Contribution from the Department of Agronomy, Illinois Agr. Exp. Sta., Urbana, Ill; pp. 433-435, 1961.
Begna, S. H. et al., "Effects of Population Density and Planting Pattern on the Yield and Yield Components of Leafy Reduced-Stature Maize in a Short-Season Area"; J. Agronomy & Crop Science 179, pp. 9-17; 1997.
Cox, W. et al., "Corn Silage and Grain Yield Responses to Plant Densities"; J. Prod. Agric., vol. 10, No. 3, pp. 405-410, 1997.
"4 Series Sprayers", published in May 2016, obtained from <https://www.deere.com/en_CAF/docs/product/equipment/4_Series_Sprayers.pdf> (2016).
"Corn Herbicide Application Timings", published online by PennState Extension; obtained from <https://extension.psu.edu/corn-herbicide-application-timings> (2015).
Amanullah, et al., "Phenology, growth, and grain yield of maize as influenced by foliar applied urea at different growth stages", Journal of Plant Nutrition 33.1, 71-79, 2009.
Butzen, "Timing Corn Harvest," Crop Insights, (Sep. 2018).
Chen, et al., "Identification and genetic mapping for rht-DM, a dominant dwarfing gene in mutant semi-dwarf maize using QTL-seq approach," Genes & Genomics 40, pp. 1091-1099 (Jun. 2018) (electronic publication).
Crommelinck, et al., "Simulating an Autonomously Operating Low-Cost Static Terrestrial LiDAR for Multitemporal Maize Crop Height Measurements," Remote Sensing, 8(3):205, pp. 1-17 (2016).
D'Andrea, et al., "Genotypic Variability in Morphological and Physicological Traits among Maize Inbred Lines—Nitrogen Responses," Crop Sci., 46:1266-1276 (2006).
Elmore, et al., "In-Field Drydown Rates and Harvest," Iowa State University Extension and Outreach, retrieved from <https://crops.extension.iastate.edu/cropnews/2010/09/field-drydown-rates-and-harvest> (Sep. 28, 2010).
International Search Report and Written Opinion mailed Apr. 22, 2020, in International Application No. PCT/US2019/064270, pp. 1-14.
International Search Report and Written Opinion mailed May 10, 2019, in International Application No. PCT/US2019/018127.
International Search Report and Written Opinion mailed Aug. 8, 2019, in International Application No. PCT/US2019/018129.
Lu, "Chapter 3 Research on Production Increase Technology in Late Harvesting of Maize in Optimum Period," Theory and Technology of Maize High Yield (2015).
Mourtzinis, et al., "Corn Grain and Stover Yield Prediction at RI Growth Stage," Agronomy Journal, 105(4):1045-1050 (2013).
Qiao, et al., "The influence of RNAi targeting of OsGA20ox2 gene on plant height in rice", Plant Molecular Biology Reporter 29.4 (2011), 952-960.
Ritchie, S.W. et al., "How corn plants develops," Special Report No. 48, Iowa State University, CES, Ames, IA, Reprinted 1996.
Supplementary European Search Report dated Oct. 11, 2022 in EP 19 89 2688.
Spelhaug, "Predicting Your Corn Harvest Date," Peterson Farms Seed (2013).
Thomison, et al., "Corn Response to Harvest Date a Affected by Plant Population and Hybrid," Agron J. 103, pp. 1765-1772 (Sep. 2011) (electronic publication).
Wang, et al., "Analysis of hormone sensitivity of a dwarf mutant of maize," Journal of Northwest A&F University, Nat. Sci. Ed., 45(8) (2017).
Weng, et al., "Genome-Wide Association Study Identifies Candidate Genes That Affect Plant Height in Chinese Elite Maize (*Zea mays* L.) Inbred Lines," PLoS One, 6(12) (2011).
Zaidi, et al., "Phenotyping for Abiotic Stress Tolerance in Maize Heat Stress," CIMMYT, pp. 1-40 (2016).
Israelsen et al., Harvesting Corn Silage by Plant Moisture article adapted from Crop and Soils Magazine, Utah State University Agricultural Extension Agents, 2009.
Altschul, "Basic local alignment search tool." *Journal of Molecular Biology*, 15:403-410 (1990).
De Pater et al., "The promoter of the rice gene GOS2 is active in various different monocot tissues and binds rice nuclear factor ASF-1," *The Plant Journal*, 2(6): 837-844 (1992).
GenBank Accession No. AY366085.1 "*Zea mays* cultivar B73 PGP1 (pgp1) gene, complete cds," National Library of Medicine: National Center for Biotechnology Information, (Oct. 2003).
Guo et al., "RNA Silencing in Plants: Mechanism, Technologies and Applications in Horticulture Crops," *Current Genomics*, 17(6):476-489 (2016).
Hanway, "How a corn plant develops," Special Report No. 48, Iowa State University, CES, Ames, IA, (1966).
Inada, "Quality controls induced by aberrant translation," *Nucleic Acids Research*, 48(3): 1084-1096 (2020).
Karamyshev et al., "Lost in Translation: Ribosome-Associated mRNA and Protein Quality Controls," *Frontiers in Genetics*, 9:431 (2018).
Kempton, "Hertitable Characters of Maize: II Brachytic Culms," *Journal of Heredity*, 11(3): 111-115 (1920).
Last et al., "pEmu: an improved promoter for gene expression in cereal cells," *Theoretical and Applied Genetics*, 81: 581-588 (1991).
Multani et al., "Loss of an MDR Transporter in Compact Stalks of Maize br2 and Sorghum dw3 Mutants," *Science*, 302(5642): 81-84 (2003).
Nickless et al., "Control of gene expression through the nonsense-mediated RNA decay pathway," *Cell & Bioscience*, 7:26 (2017).
Pilu et al., "Isolation and characterization of a new mutant allele of brachytic 2 maize gene," *Molecular Breeding*, 20:83-91(2007).
Szádeczky-Kardoss et al., "The nonstop decay and the RNA silencing systems operate cooperatively in plants," *Nucleic Acids Research*, 46(9): 4632-4648 (2018).
Thompson et al., "Clustal W: Improving the sensitivity of progressive multiple sequence alignment through sequence weighting, position-specific gap penalties and weight matrix choice," *Nucleic Acids Research*, 22: 4673-4680 (1994).
Wilson et al., "Molecular Mechanisms of RNA Interference," *Annual Review of Biophysics*, 42: 217-39 (2013).
Anonymous, Proceedings of the Caribbean Food Crops Society Fourth Annual Meeting, 1996.
U.S. Appl. No. 18/182,207, filed Filed Mar. 10, 2023, Cannon et al.
U.S. Appl. No. 18/176,206, filed Filed Feb. 28, 2023, Barten et al.
Goodman, Why do farmers leave dying corn in fields? Ask a farmer, Beef Runner, 2014.
Li et al., Difference in corn kernel moisture content between pre- and post-harvest, Journal of Integrative Agriculture 20(7): 1775-1782, 2021.
Xing, et al. "A rare SNP mutation in Brachytic2 moderately reduces plant height and increases yield potential in maize." Journal of Experimental Botany, vol. 66, Issue 13, pp. 3791-3802, (2015).
Trellis. "When Should I Stop Irrigating?" (2018). Accessed from <https://www.mytrellis.com/blog/when-should-I-stop-irrigating>.
Lo, et al. "Ectopic expression of specific GA2 oxidase mutants promotes yield and stress tolerance in rice." Plant. Biotech. J. 15:850-864, (2017).
U.S. Appl. No. 18/866,453, filed Nov. 15, 2024, Cargill, et al.
GenBank AJ132435.1. "*Arabidopsis thaliana* mRNA for GA 2-oxidase, gene ga2ox1" Dated 1999. Retrieved from: <https://www.ncbi.nlm.nih.gov/nuccore/AJ132435>.

(56) References Cited

OTHER PUBLICATIONS

International Search Report and Written Opinion for International Application No. PCT/US2023/66999 mailed Nov. 2, 2023.
Dhaliwal, et al., "Comparative analysis of ABCB1 reveals novel structural and functional conservation between monocots and dicots." Frontiers in Plant Science, 2014, vol. 5, Article 657.
Knoller, et al., "Brachytic2/ZmABCB1 functions in IAA export from intercalary meristems." J. Exp. Botany, 61:3689-3696 (2010).
Uniprot A0A2P1BTK0_Maize. Brachytic 2. Accessed on Dec. 27, 2024. Accessed from <https://www.uniprot.org/uniprotkb/A0A2P1BTK0/entry>.
Search Report dated Jul. 21, 2022, in Chinese Application 2017800639820 including English translation of related Office Action.
Allen, et al., "Evolution of microRNA genes by inverted duplication of target gene sequences in *Arabidopsis thaliana*," Nature Genetics, 36:1282-1290 (2004).
Allen, et al., "microRNA-directed phasing during Trans-acting siRNA biogenesis in plants," Cell, 121(2):207-221 (2005).
Altschul, et al., "Basic Local Alignment Search Tool," Journal of Molecular Biology, 215(3):403-410 (1990).
Altschul, et al., "Gapped BLAST and PSI-BLAST: a new generation of protein database search programs," Nucleic Acids Research, 25 (17) : 3389-3402 (1997).
Ashikari, et al., "Loss-of-function of a Rice Gibberellin Biosynthetic Gene, GA20 oxidase (GA20ox-2), Led to the Rice 'Green Revolution'," Breeding Science, 52:143-150 (2002).
Axtell, et al., "A Two-Hit Trigger for siRNA Biogenesis in Plants," Cell, 127:565-577 (2006).
Beurdeley, et al., "Compact designer TALENs for efficient genome engineering", Nature Communications, 4: 1762 (2013).
Cai, et al., "Molecular Cloning, Characterization, and Expression Analysis of Genes Encoding Gibberellin 20-Oxidase in *Dasypyrum villosum* Dwarf Mutant," Plant Molecular Biology Reporter, 30:1110-1116 (2012).
Carrera, et al.,"Changes in GA 20-oxidase gene expression strongly affect stem length, tuber induction and tuber yield of potato plants," The Plant Journal, 22(3):247-256 (2000).
Cermak, et al., "Efficient design and assembly of custom TALEN and other TAL effector-based constructs for DNA targeting," Nucleic Acids Research, 39(12):e82 (2011).
Chen, et al., "Identification and Functional Analysis of Flowering Related microRNAs in Common Wild Rice (*Oryza rufipogon* Griff.)," PLoS One, 8:e82844 (2013).
Chen, et al., "New insight in the Gibberellin biosynthesis and signal transduction," Plant Signaling & Behavior, 10(5):e1000140-1-e1000140-3:(2015).
Chen, et al., "The Maize DWARF1 Encodes a Gibberellin 3-Oxidase and Is Dual Localized to the Nucleus and Cytosol," Plant Physiology, 166:2028-2039 (2014).
Chenna, et al., "Multiple sequence alignment with the Clustal series of programs," Nucleic Acids Research, 31(13):3497-3500 (2003).
Ciampitti, et al., "A comprehensive study of plant density consequences on nitrogen uptake dynamics of maize plants from vegetative to reproductive stages," Field Crops Research, 121(1):2-18 (2011).
Coles, et al., "Modification of gibberellin production and plant development in *Arabidopsis* by sense and antisense expression of gibberellin 20-oxidase genes," The Plant Journal, 17(5):547-556 (1999).
Davis, et al., "Gibberellin Biosynthesis in Maize. Metabolic Studies with $GA_{15}$, $GA_{24}$, $GA_{25}$, $GA_7$, and 2,3-Dehydro-$GA_9$[1]," Plant Physiology, 121(3):1037-1045 (1999).
Doyle, et al., "TAL Effector-Nucleotide Targeter (TALE-NT) 2.0: tools for TAL effector design and target prediction," Nucleic Acids Research, 40(W1):17-122 (2012).
Du, et al., "Cloning and characterization of an up-regulated GA 20-oxidase gene in hybrid maize," Natural Science, 19(2):161-166 (2009).
Eriksson, et al., "$GA_4$ Is the Active Gibberellin in the Regulation of LEAFY Transcription and *Arabidopsis* Floral Initiation," The Plant Cell, 18(9):2172-2181 (2006).
Extended European Search Report dated Mar. 9, 2020, in European Patent Application No. 17842139.2.
Fagoaga, et al., "Engineering of gibberellin levels in citrus by sense and antisense overexpression of a GA 20-oxidase gene modifies plant architecture," Journal of Experimental Botany, 58(6):1407-1420 (2007).
Fambrini, et al., "The extreme dwarf phenotype of the GA-sensitive mutant of sunflower, dwarf2, is generated by a deletion in the ent-kaurenoic acid oxidase1 (HaKA01) gene sequence," Plant Molecular Biology, 75:431-450 (2011).
Franco-Zorrilla, et al., "Target mimicry provides a new mechanism for regulation of microRNA activity," Nature Genetics, 39: 1033-1037 (2007).
Gabsalilow, et al., "Site- and strand-specific nicking of DNA by fusion proteins derived from MutH and I-Scel or TALE repeats," Nucleic Acids Research, 41(7):e83 (2013).
Gaj, et al.. "ZFN, TALEN, and CRISPR/Cas-based methods for genome engineering," Trends Biotechnology, 31(7):397-405 (2013).
GenBank Accession No. AY105651.1, "*Zea mays* PC0130567 mRNA sequence," pp. 1-2, dated May 28, 2008.
GenBank Accession No. BT068785.2, "*Zea mays* full-length cDNA clone ZM_BFb0382B03 mRNA, complete cds," pp. 1-2, dated Jun. 15, 2012.
GenBank Accession No. EU963664.1, "*Zea mays* clone 265382 gibberellin 20 oxidase 2 mRNA, complete cds," pp. 1, dated Dec. 10, 2008.
Griffiths-Jones, et al., "Rfam: an RNA family database," Nucleic Acids Research, 31(1):439-441 (2003).
Gupta, et al., "Gibberellic acid in plant Still a mystery unresolved," Plant Signaling & Behavior, 8(9):e25504 (2013).
Han, et al., "Gibberellin-associated cisgenes modify growth, stature and wood properties in Populus," Plant Biotechnology Journal, 9(2):162-178 (2011).
Hedden, "Gibberellin Biosynthesis: Enzymes, Genes and Their Regulation," Annu. Rev. Plant Physiol. Plant Mol. Biol., 48:431-60 (1997).
Hedden, "The genes of the Green Revolution," Trends in Genetics, 19(1):5-9 (2003).
Helliwell, et al."Constructs and Methods for Hairpin RNA-Mediated Gene Silencing in Plants," Methods in Enzymology, 392:24-35 (2003).
Huang, et al., "A Gibberellin-Mediated DELLA-NAC Signaling Cascade Regulates Cellulose Synthesis in Rice," The Plant Cell, 27(6):1681-1696 (2015).
Copenheaver. International Search Report and Written Opinion mailed Dec. 28, 2017, in International Application No. PCT/US2017/047405.
Jia, et al., "GA-20 oxidase as a candidate for the semidwarf gene sdw1/denso in barley," Functional & Integrative Genomics, 9:255-262 (2009).
Jia, et al., "Molecular characterization and functional analysis of barley semi-dwarf mutant Riso No. 9265," BMC Genomics, 16(927):1-11 (2015).
Jones-Rhoades, et al., "Computational Identification of Plant MicroRNAs and Their Targets, Including a Stress-Induced miRNA," Molecular Cell, 14(6):787-799 (2004).
Kamthan, et al., "Small RNAs in plants: recent development and application for crop improvement" Frontiers in Plant Science, 6:1-17 (2015).
Katoh, et al., "Specific residues at every third position of siRNA shape its efficient RNAi activity," Nucleic Acids Research, 35(4):e27 (2007).
Khvorova, et al., "Functional siRNAs and miRNAs Exhibit Strand Bias," Cell, 115(2):209-216 (2003).
Kim, "MicroRNA Biogenesis: Coordinated Cropping and Dicing," Nature Reviews Molecular Cell Biology, 6:376-385 (2005).
King, et al., "Selective Deactivation of Gibberellins below the Shoot Apex is Critical to Flowering but Not to Stem Elongation of Lolium," Molecular Plant, 1(2):295-307 (2008).

(56) References Cited

OTHER PUBLICATIONS

Kobayashi, et al., "Gibberellin Metabolism in Maize," Plant Physiology, 110(2):413-418 (1996).
Kusaba, et al., "Isolation and expression analysis of gibberellin 20-oxidase homologous gene in apple," Journal of Experimental Botany, 52(335):375-376 (2001).
Lange, et al., "Gibberellin Biosynthesis and the Regulation of Plant Development," Plant Biology, 8(3):281-290 (2006).
Larkin, et al., "Clustal W and Clustal X version 2.0," Bioinformatics, 23(21):2947-48 (2007).
Liu, et al., "Analysis of Complementarity Requirements for Plant MicroRNA Targeting Using a *Nicotiana benthamiana* Quantitative Transient Assay," The Plant Cell, 26(2):741-753 (2014).
McElroy, et al., "Construction of expression vectors based on the rice actin 1 (Act1) 5' region for use in monocot transformation," Molecular and General Genetics MGG, 231:150-160 (1991).
Mitchum, et al., "Distinct and overlapping roles of two gibberellin 3-oxidases in *Arabidopsis* development," The Plant Journal, 45(5):804-818 (2006).
Molina, et al., "Transformation of a Dwarf *Arabidopsis* Mutant Illustrates Gibberellin Hormone Physiology and the Function of a Green Revolution Gene," Biochemistry and Molecular Biology Education, 37(3): 170-177 (2009).
Mutasa-Gottgens, et al., "Gibberellin as a factor in floral regulatory networks," Journal of Experimental Botany, 60(7):1979-1989 (2009).
Offtype—Definition of Offtype by Merriam-Webster, pp. 1, retrieved Sep. 18, 2023 <https://www.merriam-webster.com/dictionary/offtype>.
Oikawa, et al., "A role of OsGA20ox1, encoding an isoform of gibberellin 20-oxidase, for regulation of plant stature in rice," Plant Molecular Biology, 55:687-700 (2004).
Ookawa, et al., "Precise estimation of genomic regions controlling lodging resistance using a set of reciprocal chromosome segment substitution lines in rice," Scientific Reports, 6(30572) pp. 1-12 (2016).
Parizotto, et al., "In vivo investigation of the transcription, processing, endonucleolytic activity, and functional relevance of the spatial distribution of a plant miRNA," Genes & Development, 18:2237-2242 (2004).
Pater, et al., "The promoter of the rice gene GOS2 is active in various different monocot tissues and binds rice nuclear factor ASF-1," The Plant Journal, 2(6):837-844 (1992).
Peiffer, et al., "The Genetic Architecture Of Maize Height," Genetics, 196(4):1337-1356 (2014).
Peng, et al., "'Green revolution' genes encode mutant gibberellin response modulators," Nature, 400:256-261 (1999).
Petti, et al., "Mapping of a Cellulose-Deficient Mutant Named dwarf1-1 in Sorghum bicolor to the Green Revolution Gene gibberellin20-oxidase Reveals a Positive Regulatory Association between Gibberellin and Cellulose Biosynthesis," Plant Physiology, 169(1):705-716 (2015).
Plackett, et al., "Analysis of the Developmental Roles of the *Arabidopsis* Gibberellin 20-Oxidases Demonstrates That GA20ox1, -2, and -3 Are the Dominant Paralogs," The Plant Cell, 24(3):941-960 (2012).
Qiao, et al., "Alteration of rice growth and development via antisense expression of OsGA20ox2 gene," African Journal of Biotechnology, 12(5):3898-3904 (2013).
Qiao, et al., "Modification of plant height via RNAi suppression of OsGA20ox2 gene in rice," Euphytica, 158-35-45 (2007).
Qiao, et al., "The Influence of RNAi Targeting of OsGA20ox2 Gene on Plant Height in Rice," Plant Molecular Biology Reporter, 29:952-960 (2011).
Reynolds, et al., "Rational siRNA design for RNA interference," Nature Biotechnology, 22(3):326-330 (2004).
Rhoades, et al., "Prediction of Plant MicroRNA Targets," Cell, 110(4):513-520 (2002).
Rieu, et al., "The gibberellin biosynthetic genes AtGA20ox1 and AtGA20ox2 act, partially redundantly, to promote growth and development throughout the Arabidopsis life cycle," The Plant Journal, 53 :488-504 (2008).
Ross, et al., "Gibberellin mutants," Physiologia Plantarum, 100(3):550-560 (1997).
Sarkar, et al., "Relationship between gibberellins, height, and stress tolerance in barely (*Hordeum vulgare* L.) seedlings," Plant Growth Regulation, 42:125-135 (2004).
Sasaki, et al., "A mutant gibberellin-synthesis gene in rice," Nature, 416:701-702 (2002).
Search Report dated Jun. 24, 2021, in Russian Patent Application 2019105536, and English translation of the same (pp. 1-4).
Singh, "The green revolution and the evolution of agricultural education and research in India," Genome, 42(4):557-561 (1999).
Song, et al., "Association of the molecular regulation of ear leaf senescence/stress response and photosynthesis/metabolism with heterosis at the reproductive stage in maize," Scientific Reports, 6: 29843 (2016).
Song, et al., "Flowering time regulation: photoperiod- and temperature-sensing in leaves," Trends in Plant Science, 18(10):575-583 (2013).
Song, et al., "Genome-wide identification of gibberellins metabolic enzyme genes and expression profiling analysis during seed germination in maize," Gene, 482(1-2):34-42 (2011).
Spielmeyer, et al., "Semidwarf (sd-1), "green revolution" rice, contains a defective gibberellin 20-oxidase gene," PNAS, 99(13):9043-9048 (2002).
Sun, "Gibberellin Metabolism, Perception and Signaling Pathways in *Arabidopsis*," The Arabidopsis Book, 2008(6): pp. 1-28 (2008).
Sunkar, et al., "Novel and Stress-Regulated MicroRNAs and Other Small RNAs from *Arabidopsis*," Plant Cell, 16(8):2001-2019 (2004).
Supplementary Partial European Search Report dated Jan. 14, 2020, in European Patent Application No. 17842139.2.
Svitashev, et al., "Targeted Mutagenesis, Precise Gene Editing, and Site-Specific Gene Insertion in Maize Using Cas9 and Guide RNA," Plant Physiology, 169(2):931-945 (2015).
Teng, et al., "ZmGA3ox2, a candidate gene for a major QTL, qPH3.1, for plant height in maize," The Plant Journal, 73(3):405-416 (2013).
Thompson, et al., "Clustal W: improving the sensitivity of progressive multiple sequence alignment through sequence weighting, position-specific gap penalties and weight matrix choice," Nucleic Acids Research, 22(22):4673-4680 (1994).
Tollenaar, et al., "Effect of Defoliation on Kernel Development in Maize," Canadian Journal of Plant Science, 58(1):207-212 (1978).
Tong, et al., "Reply: Brassinosteroid Promotes Cells Elongation by Regulating Both Synthesis and Signaling of Gibberellin: Critical Comments on Ross and Quittenden's Letter," The Plant Cell, vol. 28, pp. 833-835, (2016).
Traore, et al., "Bt and Non-Bt Maize Growth and Development as Affected by Temperature and Drought Stress," Agronomy Journal, 92(5): 1027-1035 (2000).
Unterholzner, et al., "Reply: Interaction Between Brassinosteroids and Gibberellins: Synthesis or Signaling? In *Arabidopsis* Both!," The Plant Cell, vol. 28, pp. 836-839, (2016).
Urakami, et al., "Immunomodulation of gibberellin biosynthesis using an anti-precursor gibberellin antibody confers gibberellin-deficient phenotypes," Planta, 228:863-873 (2008).
Voytas, "Plant Genome Engineering with Sequence-Specific Nucleases," Annual Review of Plant Biology, 64:327-50 (2013).
Wang, et al., "Gibberellin Biosynthetic Deficiency Is Responsible for Maize Dominant Dwarf11 (D11) Mutant Phenotype: Physiological and Transcriptomic Evidence," PLoS One, 8(6):e66466:1-8 (2013).
Wang, et al., "More than meets the eye? Factors that affect target selection by plant miRNAs and heterochromatic siRNAs," Current Opinion Plant Biology, 27:118-124 (2015).
Weng, et al.,"Genome-Wide Association Study Identifies Candidate Genes That Affect Plant Height in Chinese Elite Maize (*Zea mays* L.) Inbred Lines," PLoS One, 6(12):e29229 pp. 1-8 (2011).
Wu, et al., "Target specificity of the CRISPR-Cas9 system," Quantitative Biology, 2(2):59-70 (2014).
Xiao, et al., "Dissection of GA 20-oxidase members affecting tomato morphology by RNAi-mediated silencing," Plant Growth Regulation, 50:179-189 (2006).

(56) References Cited

OTHER PUBLICATIONS

Yamaguchi, et al., "Gibberellin Acts Positively Then Negatively to Control Onset of Flower Formation in *Arabidopsis*," Science, 344(6184):638-641 (2014).
Yamaguchi, "Gibberellin Metabolism and its Regulation," Annual Review of Plant Biology, 59:225-251 (2008).
Yanik, et al., "TALE-Pvull Fusion Proteins—Novel Tools for Gene Targeting," PLoS One, 8(12):e82539 pp. 1-13 (2013).
Yin, et al., "In-Season Prediction of Corn Yield Using Plant Height under Major Production Systems," Agronomy Journal, 103(3):923-929 (2011).
Yoshikawa, et al., "A pathway for the biogenesis of trans-acting siRNAs in *Arabidopsis*," Genes & Development, 19:2164-2175 (2005).
Zeng, et al., "Both Natural and Designed Micro RNAs Can Inhibit the Expression of Cognate mRNAs When Expressed in Human Cells," Molecular Cell, 9(6): 1327-1333 (2002).
Rodriquez. Invitation to Pay Additional Fees for Application No. PCT/US23/62985 mailed May 23, 2023.
Rodriquez. International Search Report and Written Opinion for Application No. PCT/US23/62985 mailed Jul. 27, 2023.
Hill and Furrow, "Pinch or Push Your Corn: Scouting for Lodging Potential", University of Illinois Urbana-Champaign, Illinois Extension, Sep. 12, 2016, 2 pages.
Xia et al., "A book to understand high corn yield and disaster prevention and reduction technology", China Farmers Press, May 2016, p. 135.
Chinese Office Action regarding Chinese Patent Application No. 201980025083.0, dated Dec. 1, 2023, 19 pages.
Elmore and Abendroth, How Fast Can Corn Dry Down? Iowa State University Extension and Outreach, available at https://crops.extension.iastate.edu/encyclopedia/how-fast-can-corn-dry-down, 2007.
Da Silva et al., Adaptability and Stability of Corn Hybrids Grown for Grain Yield, Maringa 36(2): 175-181, 2014.
Da Silva et al., Adaptability and Stability of Com Hybrids Grown for Grain Yield, Maringa 36(2): 175-181, 2014.
U.S. Appl. No. 19/337,629, filed Sep. 23, 2025, Cannon et al.
U.S. Appl. No. 19/367,230, filed Oct. 23, 2025, Barten et al.

* cited by examiner

METHODS FOR IMPROVED HYBRID CORN SEED PRODUCTION

CROSS-REFERENCE TO RELATED APPLICATIONS

This application claims benefit of U.S. Provisional Application No. 63/117,231, filed Nov. 23, 2020; U.S. Provisional Application No. 63/117,237, filed Nov. 23, 2020; U.S. Provisional Application No. 63/117,247, filed Nov. 23, 2020; U.S. Provisional Application No. 63/117,225, filed Nov. 23, 2020; and U.S. Provisional Application No. 63/125,752, filed Dec. 15, 2020; and U.S. Provisional Application No. 63/180,344, filed Apr. 27, 2021, all of which are incorporated by reference in their entireties herein.

INCORPORATION OF SEQUENCE LISTING

The instant application contains a Sequence Listing which has been submitted electronically in ASCII format and is hereby incorporated by reference in its entirety. Said ASCII copy, created on Nov. 19, 2021, is named P35024US01 SL.txt and is 1,161,028 bytes in size.

FIELD OF THE INVENTION

The present disclosure relates to methods of improving hybrid corn seed production.

BACKGROUND

Hybrid corn seeds are produced by crossing two different parental inbred corn lines. Increasing the profitability of commercial corn seed production largely relies on the ability to improve female inbred plant yield. A need continues to exist in the art for further improvements in the efficiency and productivity of corn seed production, especially if agricultural demand and costs of production continue to rise.

SUMMARY

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_3 locus, wherein the mutant allele comprises a DNA segment inserted into the endogenous GA20 oxidase_3 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_3 locus produces a RNA transcript comprising the antisense RNA sequence; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a DNA segment inserted into the endogenous GA20 oxidase_5 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_5 locus produces a RNA transcript comprising the antisense RNA sequence; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of an endogenous Brachytic2 (Br2) locus, wherein the mutant allele comprises a DNA segment inserted into the endogenous Br2 locus, wherein the DNA segment encodes an antisense RNA that is at least 70% complementary to at least 20 consecutive nucleotides of SEQ ID NO: 132 or 180, and wherein the mutant allele of the endogenous Br2 locus produces an RNA transcript comprising the antisense RNA sequence; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of an endogenous Brachytic2 (Br2) locus, wherein the mutant allele comprises a deletion of at least one nucleotide from an endogenous Br2 locus as compared to SEQ ID NO: 132; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a premature stop codon within a nucleic acid sequence encoding a Brachytic2 protein as compared to a control corn plant; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants comprise a short stature phenotype exhibited by an average height that is at least 2.5% lower than the average height of the at least one male inbred corn plant, wherein the female inbred corn plants comprise a dominant or semi-dominant transgene or mutant allele of a gene, and wherein the transgene or mutant allele causes the short stature phenotype of the female inbred corn plants; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_3 locus, wherein the mutant allele comprises a DNA segment inserted into the endogenous GA20 oxidase_3 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_3 locus produces a RNA transcript comprising the antisense RNA sequence; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a DNA segment inserted into the endogenous GA20 oxidase_5 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_5 locus produces a RNA transcript comprising the antisense RNA sequence; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of an endogenous Brachytic2 (Br2) locus, wherein the mutant allele comprises a DNA segment inserted into the endogenous Br2 locus, wherein the DNA segment encodes an antisense RNA that is at least 70% complementary to at least 20 consecutive nucleotides of SEQ ID NO: 132 or 180, and wherein the mutant allele of the endogenous Br2 locus produces an RNA transcript comprising the antisense RNA sequence; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of an endogenous Brachytic2 (Br2) locus, wherein the mutant allele comprises a deletion of at least one nucleotide from an endogenous Br2 locus as compared to SEQ ID NO: 132; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a premature stop codon within a nucleic acid sequence encoding a Brachytic2 protein as compared to a control corn plant; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants comprise a short stature phenotype exhibited by an average height that is at least 2.5% lower than the average height of the at least one male inbred corn plant, wherein the plurality of female inbred corn plants comprise a dominant or semi-dominant transgene or mutant allele of a gene, and wherein the transgene or mutant allele causes the short stature phenotype of the plurality of female inbred corn plants; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_3 locus, wherein the mutant allele comprises a DNA segment inserted into the endogenous GA20 oxidase_3 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_3 locus produces a RNA transcript comprising the antisense RNA sequence; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a DNA segment inserted into the endogenous GA20 oxidase_5 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_5 locus produces a RNA transcript comprising the antisense RNA sequence; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of an endogenous Brachytic2 (Br2) locus, wherein the mutant allele comprises a DNA segment inserted into the endogenous Br2 locus, wherein the DNA segment encodes an antisense RNA that is at least 70% complementary to at least 20 consecutive nucleotides of SEQ ID NO: 132 or 180, and wherein the mutant allele of the endogenous Br2 locus produces an RNA transcript comprising the antisense RNA sequence; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of an endogenous Brachytic2 (Br2) locus, wherein the mutant allele comprises a deletion of at least one nucleotide from an endogenous Br2 locus as compared to SEQ ID NO: 132; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a premature stop codon within a nucleic acid sequence encoding a Brachytic2 protein as compared to a control corn plant; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants comprise a short stature phenotype exhibited by an average height that is at least 2.5% lower than the average height of the at least one male inbred corn plant, wherein the female inbred corn plants comprise a dominant or semi-dominant transgene or mutant allele of a gene, and wherein the transgene or mutant allele causes the short stature phenotype of the female inbred corn plants; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genome modification comprising a deletion of at least a portion of the transcription termination sequence of the endogenous Zm.SAMT gene, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genome modification comprising a deletion of at least a portion of the intergenic region between the endogenous GA20 oxidase_5 and Zm.SAMT genes, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genome modification comprising a deletion of at least a portion of one or more of the following: 5' UTR, 1st exon, 1st intron, 2nd exon, 2nd intron, 3rd exon, 3' UTR, and any portion thereof, and the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any portion thereof, of the endogenous Zm.SAMT gene; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genome modification which results in the transcription of an antisense strand of at least an exon, an intron, or an untranslated region (UTR) of the endogenous GA20 oxidase_5 gene, or any portion thereof; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises the Zm.SAMT gene promoter, or a functional part thereof, operably linked to at least one transcribable antisense sequence of at least an exon, intron or untranslated region (UTR) of the endogenous GA20 oxidase_5 gene, or any portion thereof; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a sequence selected from the group consisting of SEQ ID NOs: 304-322; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a first sequence and a second sequence; wherein the first sequence comprises one or more of the 5' UTR, 1st exon, 1st intron, 2nd exon, 2nd intron, 3rd exon, 3' UTR, and any complementary sequence thereof, and any portion of the foregoing, of the endogenous Zm.GA20 oxidase_5 gene; and wherein the second sequence comprises one or more of the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any complementary sequence thereof, and any portion of the foregoing, of the endogenous Zm.SAMT gene; wherein the first sequence and the second sequence are contiguous or separated only by an intervening sequence of fewer than 555 nucleotides; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genomic deletion relative to a wild type allele of the endogenous GA20 oxidase_5 locus, wherein the genomic deletion is flanked by a first sequence and a second sequence; wherein the first sequence comprises one or more of the 5' UTR, 1st exon, 1st intron, 2nd exon, 2nd intron, 3rd exon, 3' UTR, and any complementary sequence thereof, and any portion of the foregoing, of the endogenous Zm.GA20 oxidase_5 gene; and wherein the second sequence comprises one or more of the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any complementary sequence thereof, and any portion of the foregoing, of the endogenous Zm.SAMT gene; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genomic sequence comprising a first sequence and a second sequence; wherein the first sequence comprises at least 15 consecutive nucleotides of one or more of SEQ ID NOs: 228-235 and 276-283; wherein the second sequence comprises at least 15 consecutive nucleotides of one or more of SEQ ID NOs: 235-276; and wherein the genomic sequence is at least 50 consecutive nucleotides in length, and/or fewer than 9000 consecutive nucleotides in length; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of the transcription termination sequence of the endogenous Zm.SAMT gene, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of the intergenic region between the endogenous GA20 oxidase_5 and Zm.SAMT genes, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of one or more of the following: 5' UTR, 1st exon, 1st intron, 2nd exon, 2nd intron, 3rd exon, 3' UTR, and any portion thereof, and the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any portion thereof, of the endogenous Zm.SAMT gene; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification which results in the transcription of an antisense strand of at least an exon, an intron, or an untranslated region (UTR) of the endogenous GA20 oxidase_5 gene, or any portion thereof; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises the Zm.SAMT gene promoter, or a functional part thereof, operably linked to at least one transcribable antisense sequence of at least an exon, intron or untranslated region (UTR) of the endogenous GA20 oxidase_5 gene, or any portion thereof; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a sequence selected from the group consisting of SEQ ID NOs: 304-322; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a first sequence and a second sequence; wherein the first sequence comprises one or more of the 5' UTR, 1st exon, 1st intron, 2nd exon, 2nd intron, 3rd exon, 3' UTR, and any complementary sequence thereof, and any portion of the foregoing, of the endogenous Zm.GA20 oxidase_5 gene; and wherein the second sequence comprises one or more of the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any complementary sequence thereof, and any portion of the foregoing, of the endogenous Zm.SAMT gene; wherein the first sequence and the second sequence are contiguous or separated only by an intervening sequence of fewer than 555 nucleotides; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic deletion relative to a wild type allele of the endogenous GA20 oxidase_5 locus, wherein the genomic deletion is flanked by a first sequence and a second sequence; wherein the first sequence comprises one or more of the 5' UTR, 1st exon, 1st intron, 2nd exon, 2nd intron, 3rd exon, 3' UTR, and any complementary sequence thereof, and any portion of the foregoing, of the endogenous Zm.GA20 oxidase_5 gene; and wherein the second sequence comprises one or more of the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any complementary sequence thereof, and any portion of the foregoing, of the endogenous Zm.SAMT gene; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic sequence comprising a first sequence and a second sequence; wherein the first sequence comprises at least 15 consecutive nucleotides of one or more of SEQ ID NOs: 228-235 and 276-283; wherein the second sequence comprises at least 15 consecutive nucleotides of one or more of SEQ ID NOs: 235-276; and wherein the genomic sequence is at least 50 consecutive nucleotides in length, and/or fewer than 9000 consecutive nucleotides in length; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of the transcription termination sequence of the endogenous Zm.SAMT gene, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of the intergenic region between the endogenous GA20 oxidase_5 and Zm.SAMT genes, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of one or more of the following: 5' UTR, 1st exon, 1st intron, 2nd exon, 2nd intron, 3rd exon, 3' UTR, and any portion thereof, and the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any portion thereof, of the endogenous Zm.SAMT gene; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification which results in the transcription of an antisense strand of at least an exon, an intron, or an untranslated region (UTR) of the endogenous GA20 oxidase_5 gene, or any portion thereof; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises the Zm.SAMT gene promoter, or a functional part thereof, operably linked to at least one transcribable antisense sequence of at least an exon, intron or untranslated region (UTR) of the endogenous GA20 oxidase_5 gene, or any portion thereof; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a sequence selected from the group consisting of SEQ ID NOs: 304-322; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic deletion relative to a wild type allele of the endogenous GA20 oxidase_5 locus, wherein the genomic deletion is flanked by a first sequence and a second sequence; wherein the first sequence comprises one or more of the 5' UTR, 1st exon, 1st intron, 2nd exon, 2nd intron, 3rd exon, 3' UTR, and any complementary sequence thereof, and any portion of the foregoing, of the endogenous Zm.GA20 oxidase_5 gene; and wherein the second sequence comprises one or more of the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any complementary sequence thereof, and any portion of the foregoing, of the endogenous Zm.SAMT gene; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic deletion relative to a wild type allele of the endogenous GA20 oxidase_5 locus, wherein the genomic deletion is flanked by a first sequence and a second sequence; wherein the first sequence comprises one or more of the 5' UTR, 1st exon, 1st intron, 2nd exon, 2nd intron, 3rd exon, 3' UTR, and any complementary sequence thereof, and any portion of the foregoing, of the endogenous Zm.GA20 oxidase_5 gene; and wherein the second sequence comprises one or more of the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any complementary sequence thereof, and any portion of the foregoing, of the endogenous Zm.SAMT gene; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic sequence comprising a first sequence and a second sequence; wherein the first sequence comprises at least 15 consecutive nucleotides of one or more of SEQ ID NOs: 228-235 and 276-283; wherein the second sequence comprises at least 15 consecutive nucleotides of one or more of SEQ ID NOs: 235-276; and wherein the genomic sequence is at least 50 consecutive nucleotides in length, and/or fewer than 9000 consecutive nucleotides in length; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a recombinant DNA construct comprising a transcribable DNA sequence encoding a GA2 oxidase protein and a plant-expressible promoter, wherein the transcribable DNA sequence is operably linked to the plant-expressible promoter; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a recombinant DNA construct comprising a transcribable DNA sequence encoding a GA2 oxidase protein and a plant-expressible promoter, wherein the transcribable DNA sequence is operably linked to the plant-expressible promoter; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a recombinant DNA construct comprising a transcribable DNA sequence encoding a GA2 oxidase protein and a plant-expressible promoter, wherein the transcribable DNA sequence is operably linked to the plant-expressible promoter; and (b) harvesting said hybrid corn seeds from one or more of the female inbred corn plants.

DETAILED DESCRIPTION

Figure 1:
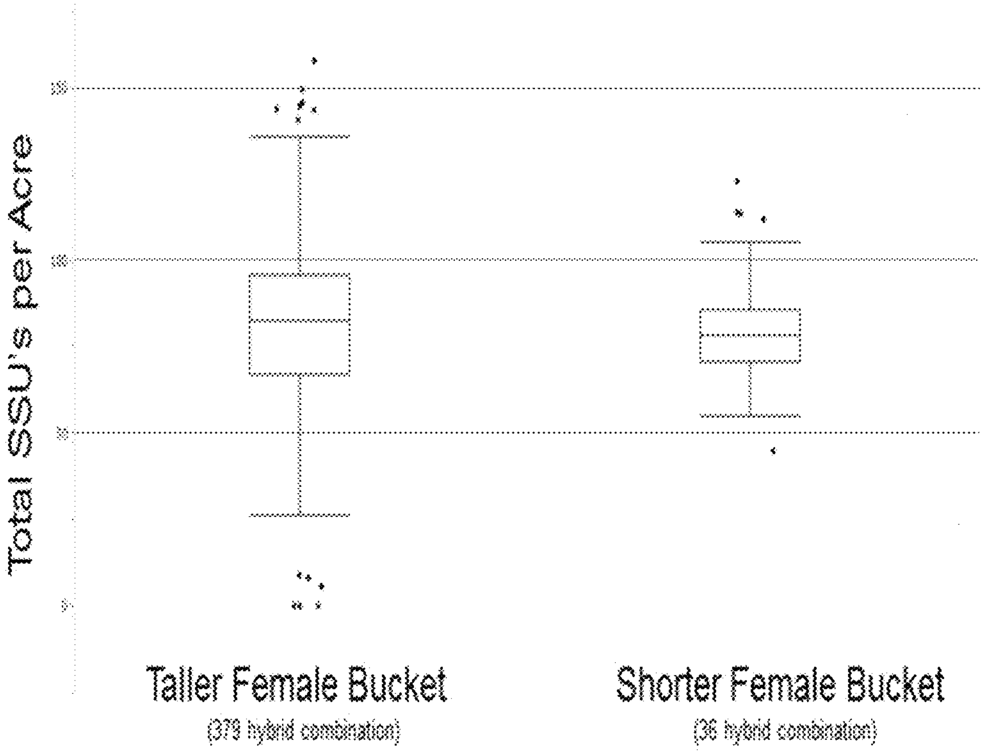
FIG. 1 is a chart illustrating the variability in hybrid corn seed yield produced for a set of 415 different hybrid corn combinations separated into two groupings based upon the average female to male parent plant height ratio for each combination.

Unless defined otherwise, all technical and scientific terms used have the same meaning as commonly understood by one of ordinary skill in the art to which this disclosure belongs. Where a term is provided in the singular, the inventors also contemplate aspects of the disclosure being described by the plural of that term. Where there are discrepancies in terms and definitions used in references that are incorporated by reference, the terms used in this application shall apply. Other technical terms that are used herein have their ordinary meaning in the art in which they are used, as can be exemplified or defined by various art-specific dictionaries, for example, "The American Heritage® Science Dictionary" (Editors of the American Heritage Dictionaries, 2011, Houghton Mifflin Harcourt, Boston and New York), the "McGraw-Hill Dictionary of Scientific and Technical Terms" (6th edition, 2002, McGraw-Hill, New York), or the "Oxford Dictionary of Biology" (6th edition, 2008, Oxford University Press, Oxford and New York).

Any references cited herein, including, e.g., all patents, published patent applications, and non-patent publications, are incorporated herein by reference in their entirety. When a grouping of alternatives is presented, any and all combinations of the members that make up that grouping of alternatives are specifically envisioned. For example, if an item is selected from a group consisting of A, B, C, and D, the inventors specifically envision each alternative individually (e.g., A alone, B alone, etc.), as well as combinations such as A, B, and D; A and C; B and C; etc. The term "and/or" when used in a list of two or more items means any one of the listed items by itself or in combination with any one or more of the other listed items. For example, the expression "A and/or B" is intended to mean either or both of A and B—i.e., A alone, B alone, or A and B in combination. The expression "A, B and/or C" is intended to mean A alone, B alone, C alone, A and B in combination, A and C in combination, B and C in combination, or A, B, and C in combination.

As used herein, terms in the singular, and the singular forms "a," "an," and "the," for example, include plural referents unless the content clearly dictates otherwise.

As is well understood in the art, metric measurement values provided herein can be easily converted to standard (S.I.) units and vice versa.

As used herein, "plant" includes an explant, plant part, seedling, plantlet or whole plant at any stage of regeneration or development. As commonly understood, a "corn plant" or "maize plant" refers to any plant of species *Zea mays* and includes all plant varieties that can be bred with corn, including wild maize species. In an aspect, corn plants disclosed herein are selected from the subspecies *Zea mays* L. ssp. mays. In an additional aspect, corn plants disclosed herein are selected from the group *Zea mays* L. subsp. mays Indentata, otherwise known as dent corn. In another aspect, corn plants disclosed herein are selected from the group *Zea mays* L. subsp. *Mays indurata*, otherwise known as flint corn. In an aspect, corn plants disclosed herein are selected from the group *Zea mays* L. subsp. *Mays saccharata*, otherwise known as sweet corn. In another aspect, corn plants disclosed herein are selected from the group *Zea mays* L. subsp. *Mays amylacea*, otherwise known as flour corn. In a further aspect, corn plants disclosed herein are selected from the group *Zea mays* L. subsp. *Mays everta*, otherwise known as popcorn. Plants disclosed herein also include hybrids, inbreds, partial inbreds, or members of defined or undefined populations.

As used herein, a "plant part" can refer to any organ or intact tissue of a plant, such as a meristem, shoot organ/structure (e.g., leaf, stem or node), root, flower or floral organ/structure (e.g., bract, sepal, petal, stamen, carpel, anther and ovule), seed, embryo, endosperm, seed coat, fruit, the mature ovary, propagule, or other plant tissues (e.g., vascular tissue, dermal tissue, ground tissue, and the like), or any portion thereof. Plant parts of the present disclosure can be viable, nonviable, regenerable, and/or non-regenerable. A "propagule" can include any plant part that can grow into an entire plant.

As used herein, a "locus" is a chromosomal locus or region where a polymorphic nucleic acid, trait determinant, gene, or marker is located. A "locus" can be shared by two homologous chromosomes to refer to their corresponding locus or region. Without being limiting, a locus can comprise a polynucleotide that encodes a protein or an RNA. A locus can also comprise a non-coding RNA. A locus can comprise a gene. A locus can comprise a promoter, a 5'-untranslated region (UTR), an exon, an intron, a 3'-UTR, or any combination thereof. A locus can comprise a coding region.

As used herein, an "allele" refers to an alternative (e.g., variant) nucleic acid sequence of a gene or at a particular locus (e.g., a nucleic acid sequence of a gene or locus that is different than other alleles for the same gene or locus). Such an allele can be considered (i) wild-type or (ii) mutant if one or more mutations or edits are present in the nucleic acid sequence of the mutant allele relative to the wild-type allele. A mutant or edited allele for a gene may have a reduced or eliminated activity or expression level for the gene relative to the wild-type allele. According to present embodiments, a mutant or edited allele for a gene may have an inversion or antisense sequence that may be complementary to another portion of the gene and/or a coding sequence of another copy or allele of the gene and/or another gene. For diploid organisms such as corn, a first allele can occur on one chromosome, and a second allele can occur at the same locus on a second homologous chromosome. If one allele at a locus on one chromosome of a plant is a mutant or edited allele and the other corresponding allele on the homologous chromosome of the plant is wild-type, then the plant is described as being heterozygous for the mutant or edited allele. However, if both alleles at a locus are mutant or edited alleles, then the plant is described as being homozygous for the mutant or edited alleles. A plant homozygous for mutant alleles at a locus may comprise the same mutant or edited allele or different mutant or edited alleles if heteroallelic or biallelic.

As used herein, an "endogenous locus" refers to a locus at its natural and original chromosomal location. As used herein, the "endogenous GA20 oxidase_3 locus" refers to the GA20 oxidase_3 genic locus at its original chromosomal location. As used herein, the "endogenous GA20 oxidase_5 locus" refers to the GA20 oxidase_5 genic locus at its original chromosomal location. As used herein, the "endogenous GA3 oxidase locus" refers to the GA3 oxidase genic locus at its original chromosomal location. As used herein, the "endogenous br2 locus" refers to the br2 genic locus at its original chromosomal location.

As used herein, the term "inbred" refers to a plant line that has been bred for genetic homogeneity. In an aspect, a corn plant provided herein can be an inbred corn plant.

As used herein, the term "parent" refers to a member of a parental line which, when crossed with another parent, produces seed that can be used to generate a set of offspring plants, which can be referred to as the first filial (F1) generation. A "parent" can be a male or female parent used to produce the seed or offspring.

As used herein, the term "hybrid" means a progeny of mating between at least two genetically dissimilar parents or inbreds. Without limitation, examples of mating schemes include single crosses (A×B), modified single cross ((A×A')×B), double modified single cross ((A×A')×(B×B')), three-way cross ((A×B)×C), modified three-way cross ((A×B)×(C×C')), and double cross ((A×B)×(C×D)) where at least one parent in a modified cross is the progeny of a cross between sister lines. In an aspect, a corn plant provided herein is a hybrid corn plant. In another aspect, a corn seed provided herein is a hybrid corn seed. In an aspect, a hybrid corn seed can be produced by crossing two different inbred corn plants or populations.

As used herein, a "female" corn plant refers to a corn plant that comprises one or more female reproductive structures that are capable of producing corn ear(s) and kernels (seed). In an aspect, a corn plant provided herein is a female corn plant. In an aspect, a female corn plant is male sterile. In another aspect, a female corn plant is detasseled. In an aspect, the male reproductive organs or flowers (e.g., tassels) of a female corn plant are chemically sterilized (e.g., by application of an herbicide to plants lacking tolerance to the herbicide in those male reproductive organs, flowers or tassels), such as with a Roundup® Hybridization System (RHS). In another aspect, the male reproductive organs or flowers (e.g., tassels) of a female corn plant are sterilized due to cytoplasmic male sterility (or CMS). It is appreciated in the art that a corn plant is monoecious and can be considered both a male corn plant and a female corn plant. In an aspect, a female corn plant is capable of producing pollen. For purposes of the present disclosure, a corn plant having one or more male reproductive organ or structure, such as tassels, and/or capable of producing pollen, is considered a "female" plant if used to generate a corn ear(s) and/or corn seed (i.e., kernels) for production and harvest. A corn plant lacking a male reproductive organ or structure, such as tassels, having a sterilized male reproductive organ or structure, and/or incapable of producing pollen, is also considered a "female" plant if used to generate a corn ear(s) and/or seed (i.e., kernels) for production and harvest. A "female" corn plant may include any pollen-receiving corn plant that produces an ear or female reproductive organ, which can receive pollen from a pollen-bearing corn plant.

As used herein, a "male" corn plant refers to a corn plant that is capable of producing pollen (e.g., form one or more tassels) and is used to pollinate and/or fertilize one or more female corn plant(s) for seed production and harvest, even if the male plant further has a female reproductive structure(s) that is/are capable of producing a corn ear and kernels (seed), which may or may not be harvested. A "male" corn plant may include any pollen-bearing (or pollen-producing) corn plant, which can provide its pollen to a pollen-receiving corn plant.

As used herein, the term "plurality" in reference to an item means two or more of such items. For example, a "plurality of plants" means two or more plants.

As used herein, the phrase "at least one" in reference to something (e.g., any object, method step, etc.) means one or more of that something. For example, "at least one plant" or "at least one plants" each means one or more plants. Accordingly, "at least one" can include one or a plurality. Thus, where the present disclosure provides "one or more" of something or "at least one" of something, then the description further supports a plurality of that something.

In an aspect, any mutant allele, mutation (e.g., without being limiting, a deletion, inversion, insertion, or combinations thereof) or transgene provided herein is present in the genome of a female plant. In an aspect, any mutant allele, mutation (e.g., without being limiting, a deletion, inversion, insertion, or combinations thereof) or transgene provided herein is present in the genome of a male plant.

In an aspect, this disclosure provides corn plants comprising a dominant mutant allele. In an aspect, this disclosure provides corn plants comprising a semi-dominant mutant allele. Dominant alleles are alleles that mask the contribution of a second allele (e.g., a wildtype allele) at the same locus (e.g., a second allele of the same gene). A dominant allele can be a "dominant negative allele" or a "dominant positive allele." Dominant negative alleles, or antimorphs, are alleles that act in opposition to normal allelic function. A dominant negative allele typically does not function normally and either directly inhibits the activity of a wild-type protein (e.g., through dimerization) or inhibits the activity of a second protein that is required for the normal function of the wild-type protein (e.g., an activator or a downstream component of a pathway). For example, a dominant negative allele abrogates or reduces the normal function of an allele in a heterozygous or homozygous state. Dominant positive alleles can increase normal gene function (e.g., a hypermorph) or provide new functions for a gene (e.g., a neomorph). A semi-dominant allele occurs when penetrance of a linked phenotype in individuals heterozygous for the allele is less than that which is observed in individuals homozygous for the allele (e.g., the masking effect is partial or incomplete).

Creation of dominant alleles that work in a heterozygous state, can speed up effective trait development, deployment, and launch of gene editing-derived products in hybrid crops such as corn. Dominant negative alleles have the potential advantage of providing a positive or beneficial plant trait in a heterozygous state—e.g., when present in a single copy. As a result, a dominant negative mutant allele can be introduced through crossing into a progeny plant from a single parent without having to introduce the allele from both parent plants as with a recessive allele.

In an aspect, a dominant mutant allele is a dominant negative allele. In an aspect, a dominant mutant allele is a dominant positive allele.

In an aspect, a dominant mutant allele or a semi-dominant mutant allele comprises an insertion, an inversion, a deletion, or any combination thereof as compared to a wildtype allele of a gene.

In an aspect, a mutant allele provided herein is a dominant mutant allele. In an aspect, a mutant allele provided herein is a semi-dominant mutant allele. In an aspect, a mutant allele provided herein is a dominant negative mutant allele.

In an aspect, a female corn plant is a modified corn plant. In another aspect, a female inbred corn plant is a modified corn plant. In an aspect, a modified plant provided herein is homozygous (or biallelic) for a dominant mutant allele(s) or transgene. In an aspect, a modified plant provided herein is homozygous (or biallelic) for a semi-dominant mutant allele(s). In an aspect, a modified plant provided herein is homozygous (or biallelic) for a dominant negative mutant allele. In an aspect, a modified plant provided herein is heterozygous or hemizygous for a dominant mutant allele or transgene. In an aspect, a modified plant provided herein is heterozygous or hemizygous for a semi-dominant mutant allele or transgene. In an aspect, a modified plant provided herein is heterozygous for a dominant negative mutant allele. As used herein, "modified", in the context of plants, seeds, plant components, plant cells, and plant genomes, refers to a state containing changes or variations from their natural or native state. According to an aspect, a modified corn plant, which may be a female corn plant, has a shorter plant height as compared to a control plant and/or a male corn plant.

As used herein, the term "control plant" (or likewise a "control" plant seed, plant part, plant cell and/or plant genome) refers to a plant (or plant seed, plant part, plant cell and/or plant genome) that is used for comparison to a modified plant (or modified plant seed, plant part, plant cell and/or plant genome) and has the same or similar genetic background (e.g., same parental lines, hybrid cross, inbred line, testers, etc.) as the modified plant (or plant seed, plant part, plant cell and/or plant genome), except for a transgenic event and/or genome edit(s) (e.g., an inversion or antisense insertion) affecting one or more genes. For example, a control plant may be an inbred line that is the same as the inbred line used to make the modified plant, or a control plant may be the product of the same hybrid cross of inbred parental lines as the modified plant, except for the absence in the control plant of any transgenic or genome edit(s) affecting one or more GA oxidase or br2 genes. Similarly, an unmodified control plant refers to a plant that shares a substantially similar or essentially identical genetic background as a modified plant, but without the one or more engineered changes to the genome (e.g., transgene, mutation or edit) of the modified plant. For purposes of comparison to a modified plant, plant seed, plant part, plant cell and/or plant genome, a "wild-type plant" (or likewise a "wild-type" plant seed, plant part, plant cell and/or plant genome) refers to a non-transgenic and non-genome edited control plant, plant seed, plant part, plant cell and/or plant genome. As used herein, a "control" plant, plant seed, plant part, plant cell and/or plant genome may also be a plant, plant seed, plant part, plant cell and/or plant genome having a similar (but not the same or identical) genetic background to a modified plant, plant seed, plant part, plant cell and/or plant genome, if deemed sufficiently similar for comparison of the characteristics or traits to be analyzed.

In an aspect, this disclosure provides a dominant mutant allele in a GA20 oxidase_3 gene. In an aspect, this disclosure provides a dominant mutant allele in a GA20 oxidase_5 gene. In an aspect, this disclosure provides a dominant mutant allele in a GA3 oxidase gene. In an aspect, this disclosure provides a dominant mutant allele in a brachytic2 gene.

In an aspect, this disclosure provides a semi-dominant mutant allele in a GA20 oxidase_3 gene. In an aspect, this disclosure provides a semi-dominant mutant allele in a GA20 oxidase_5 gene. In an aspect, this disclosure provides a semi-dominant mutant allele in a GA3 oxidase gene. In an aspect, this disclosure provides a semi-dominant mutant allele in a brachytic2 gene.

In an aspect, this disclosure provides a dominant negative mutant allele in a GA20 oxidase_3 gene. In an aspect, this disclosure provides a dominant negative mutant allele in a GA20 oxidase_5 gene. In an aspect, this disclosure provides a dominant negative mutant allele in a GA3 oxidase gene. In an aspect, this disclosure provides a dominant negative mutant allele in a brachytic2 gene.

In an aspect, a female corn plant is homozygous (or biallelic) for a mutant allele or transgene provided herein. In an aspect, a female corn plant is heterozygous for a mutant allele or transgene provided herein.

In an aspect, a dominant negative mutant allele generates an antisense RNA transcript capable of triggering suppression of an unmodified or wildtype allele of the gene. In an aspect, a dominant negative mutant allele encodes a truncated protein as compared to an unmodified allele of the gene. In an aspect, a dominant negative mutant allele generates at least one RNA transcript capable of forming a hairpin-loop secondary structure. In an aspect, the coding sequence of a dominant negative mutant allele is operably linked to a promoter of the native copy of the gene. In an aspect, a dominant negative mutant allele comprises a heterologous non-coding RNA target site in the endogenous locus of the gene. In an aspect, a dominant negative mutant allele comprises an inverted copy of the gene, or a portion thereof, adjacent to a wildtype copy of the gene at the endogenous locus of the gene. As used herein, a "portion" of a gene refers to at least 10, at least 20, at least 30, at least 40, at least 50, at least 100, at least 250, at least 500, at least 1000, or at least 2500 consecutive nucleotides of the gene. As used herein, "adjacent" refers to a nucleic acid sequence that is in close proximity, or next to another nucleic acid sequence. In one aspect, adjacent nucleic acid sequences are physically linked. In another aspect, adjacent nucleic acid sequences or genes are immediately next to each other such that there are no intervening nucleotides between the end of a first nucleic acid sequence and the start of a second nucleic acid sequence. In an aspect, a first gene and a second gene are adjacent to each other if they are separated by less than 50,000, less than 25,000, less than 10,000, less than 9000, less than 8000, less than 7000, less than 6000, less than 5000, less than 4000, less than 3000, less than 2500, less than 2000, less than 1750, less than 1500, less than 1250, less than 1000, less than 900, less than 800, less than 700, less than 600, less than 500, less than 400, less than 300, less than 200, less than 100, less than 75, less than 50, less than 25, less than 20, less than 10, less than 5, less than 4, less than 3, less than 2, or less than 1 nucleotides.

In an aspect, a dominant negative mutant allele comprises a deletion of a portion of a chromosome between a first region of the gene and a second region of the gene, wherein an antisense RNA transcript of the first region of the gene is generated following the deletion of the portion of the chromosome. In an aspect, a dominant negative mutant allele comprises a first promoter and a second promoter separated by an intervening region, wherein the first promoter and the second promoter are positioned in opposite orientations, wherein the second promoter generates at least one antisense RNA transcript, and wherein expression of the gene is reduced as compared to a control corn plant that lacks the dominant negative mutant allele. In an aspect, a dominant negative mutant allele comprises a tissue-specific or tissue-preferred promoter inserted into the gene in reverse orientation as compared to the native promoter of the gene, wherein the tissue-specific or tissue-preferred promoter generates at least one antisense RNA transcript, and wherein expression of the gene is reduced as compared to a control corn plant that lacks the dominant negative mutant allele.

In an aspect, this disclosure provides female corn plants comprising a dominant or semi-dominant transgene or mutant allele of a gene that causes a short stature phenotype. As used herein, a "short stature phenotype" refers to a dwarf corn plant, a semi-dwarf corn plant, or a brachytic corn plant. In an aspect, a plant is homozygous (or biallelic) for a transgene. In an aspect, a plant is heterozygous for a transgene. In an aspect, a plant is hemizygous for a transgene. In an aspect, a female corn plant is homozygous (or biallelic) for a transgene provided herein. In an aspect, a female corn plant is heterozygous for a transgene provided herein. In an aspect, a female corn plant is hemizygous for a transgene provided herein.

In an aspect, a transgene comprises a recombinant polynucleotide encoding an RNA molecule that suppresses expression of an endogenous GA20 oxidase gene. In an aspect, a transgene comprises a recombinant polynucleotide encoding an RNA molecule that suppresses expression of an endogenous GA20 oxidase_3 gene. In an aspect, a transgene comprises a recombinant polynucleotide encoding an RNA molecule that suppresses expression of an endogenous GA20 oxidase_5 gene. In an aspect, a transgene comprises a recombinant polynucleotide encoding an RNA molecule that suppresses expression of an endogenous GA3 oxidase gene. In an aspect, a transgene comprises a recombinant polynucleotide encoding an RNA molecule that suppresses expression of an endogenous br2 gene. In an aspect, a recombinant polynucleotide is operably linked to a promoter. In an aspect, a transgene comprises a recombinant DNA construct comprising a transcribable DNA sequence encoding a GA2 oxidase protein.

In an aspect, the corn plants provided herein are dwarf corn plants. In another aspect, the female inbred corn plants provided herein are dwarf inbred corn plants. As used herein, a "dwarf" plant refers to an atypically small plant. Generally, such a "dwarf plant" has a stature or height that is reduced relative to a control plant (e.g., a wild-type sibling plant comprising all other traits except the dwarf trait) by about 30%, 35%, 40%, 45%, 50%, 55%, 60% or greater. In an aspect, corn plants provided herein are semi-dwarf inbred corn plants.

In another aspect, the female inbred corn plants provided herein are semi-dwarf inbred corn plants. As used herein, a "semi-dwarf plant" refers to a plant having a stature or height that is reduced relative to a control plant (e.g., a wild-type sibling plant comprising all other traits except the semi-dwarf trait) by about 5%, 10%, 15%, 20%, 25%, 30%, 35%, 40%, 45% or less. Such a semi-dwarf plant can be characterized by a reduced stem, stalk, or trunk length when compared to a control wild-type plant under comparable growth conditions, which can result from fewer internodes or shorter average internode length.

As used herein, the term "polynucleotide" refers to a nucleic acid molecule containing multiple nucleotides and generally comprises at least 2, at least 5, at least 10, at least 20, at least 30, at least 40, at least 50, at least 100, at least 250, at least 500, at least 1,000, at least 1,500, at least 2,000, at least 2,500, at least 3,000, at least 5,000, or at least 10,000 nucleotide bases. As an example, a polynucleotide provided herein can be a plasmid. The use of the terms "polynucleotide" or "nucleic acid molecule" is not intended to limit the present disclosure to polynucleotides comprising deoxyribonucleic acid (DNA). For example, ribonucleic acid (RNA) molecules are also envisioned. Those of ordinary skill in the art will recognize that polynucleotides and nucleic acid molecules can comprise ribonucleotides and combinations of ribonucleotides and deoxyribonucleotides. Such deoxyribonucleotides and ribonucleotides include both naturally occurring molecules and synthetic analogues. The polynucleotides of the present disclosure also encompass all forms of sequences including, but not limited to, single-stranded forms, double-stranded forms, hairpins, stem-and-loop structures, and the like. In an aspect, a nucleic acid molecule provided herein is a DNA molecule. In another aspect, a nucleic acid molecule provided herein is an RNA molecule. In an aspect, a nucleic acid molecule provided herein is single-stranded. In another aspect, a nucleic acid molecule provided herein is double-stranded. In an aspect, a polynucleotide provided herein is single-stranded. In another aspect, a polynucleotide provided herein is double-stranded.

A non-coding RNA molecule can act as a suppression element that targets one or more gene(s) in a plant cell, such as one or more endogenous br2, GA20 or GA3 oxidase gene(s), or as a RNA molecule, such as a guide RNA, etc., that guides a sequence-specific nuclease to cut and trigger a genome editing event at a target site in the genome. Non-limiting examples of non-coding RNA molecules include a microRNA (miRNA), a miRNA precursor (pre-miRNA), a small interfering RNA (siRNA), a small RNA (18-26 nt in length) and precursor encoding same, a heterochromatic siRNA (hc-siRNA), a Piwi-interacting RNA (piRNA), a hairpin double strand RNA (hairpin dsRNA), a trans-acting siRNA (ta-siRNA), a naturally occurring antisense siRNA (nat-siRNA), a CRISPR RNA (crRNA), a tracer RNA (tracrRNA), a guide RNA (gRNA), and a single-guide RNA (sgRNA). In an aspect, a non-coding RNA provided herein is selected from the group consisting of a microRNA, a small interfering RNA, a secondary small interfering RNA, a transfer RNA, a ribosomal RNA, a trans-acting small interfering RNA, a naturally occurring antisense small interfering RNA, a heterochromatic small interfering RNA, and precursors thereof. In another aspect, a non-coding RNA provided herein is selected from the group consisting of a miRNA, a pre-miRNA, a siRNA, a hc-siRNA, a piRNA, a hairpin dsRNA, a ta-siRNA, a nat-siRNA, a crRNA, a tracrRNA, a gRNA, and a sgRNA. In another aspect, a non-coding RNA provided herein is a miRNA. In another aspect, a non-coding RNA provided herein is a siRNA.

As used herein, a "stem-loop structure" refers to a secondary structure in a RNA molecule having a double stranded region (e.g., stem) made up by two annealing RNA strands, sequences or segments of the RNA molecule, connected by a single stranded intervening RNA sequence of the RNA molecule (e.g., a loop or hairpin). A "stem-loop structure" of a RNA molecule can have a more complicated secondary RNA structure, for example, comprising self-annealing double stranded RNA sequences having internal mismatches, bulges and/or loops.

As used herein, a "native sequence" refers to a nucleic acid sequence naturally present in its original chromosomal location.

As used herein, a "wild-type gene" or "wild-type allele" refers to a gene or allele having a sequence or genotype that is most common in a particular plant species or another sequence or genotype having only natural variations, polymorphisms, or other silent mutations relative to the most common sequence or genotype that do not significantly impact the expression and activity of the gene or allele. Indeed, a "wild-type" gene or allele contains no variation, polymorphism, or any other type of mutation that substantially affects the normal function, activity, expression, or phenotypic consequence of the gene or allele relative to the most common sequence or genotype.

The terms "percent identity" or "percent identical" as used herein in reference to two or more nucleotide or protein sequences is calculated by (i) comparing two optimally aligned sequences (nucleotide or protein) over a window of comparison, (ii) determining the number of positions at which the identical nucleic acid base (for nucleotide sequences) or amino acid residue (for proteins) occurs in both sequences to yield the number of matched positions, (iii) dividing the number of matched positions by the total number of positions in the window of comparison, and then (iv) multiplying this quotient by 100% to yield the percent identity. For purposes of calculating "percent identity" between DNA and RNA sequences, a uracil (U) of a RNA sequence is considered identical to a thymine (T) of a DNA sequence. If the window of comparison is defined as a region of alignment between two or more sequences (i.e., excluding nucleotides at the 5' and 3' ends of aligned polynucleotide sequences, or amino acids at the N-terminus and C-terminus of aligned protein sequences, that are not identical between the compared sequences), then the "percent identity" may also be referred to as a "percent alignment identity". If the "percent identity" is being calculated in relation to a reference sequence without a particular comparison window being specified, then the percent identity is determined by dividing the number of matched positions over the region of alignment by the total length of the reference sequence. Accordingly, for purposes of the present disclosure, when two sequences (query and subject) are optimally aligned (with allowance for gaps in their alignment), the "percent identity" for the query sequence is equal to the number of identical positions between the two sequences divided by the total number of positions in the query sequence over its length (or a comparison window), which is then multiplied by 100%.

For optimal alignment of sequences to calculate their percent identity, various pair-wise or multiple sequence alignment algorithms and programs are known in the art, such as ClustalW, or Basic Local Alignment Search Tool® (BLAST®), etc., that may be used to compare the sequence identity or similarity between two or more nucleotide or protein sequences. Although other alignment and comparison methods are known in the art, the alignment between two sequences (including the percent identity ranges described above) may be as determined by the ClustalW or BLAST® algorithm, see, e.g., Chenna R. et al., "Multiple sequence alignment with the Clustal series of programs," *Nucleic Acids Research* 31: 3497-3500 (2003); Thompson J D et al., "Clustal W: Improving the sensitivity of progressive multiple sequence alignment through sequence weighting, position-specific gap penalties and weight matrix choice," *Nucleic Acids Research* 22: 4673-4680 (1994); and Larkin M A et al., "Clustal W and Clustal X version 2.0," *Bioinformatics* 23: 2947-48 (2007); and Altschul, S. F., Gish, W., Miller, W., Myers, E. W. & Lipman, D. J. (1990) "Basic local alignment search tool." *J. Mol. Biol.* 215:403-410 (1990), the entire contents and disclosures of which are incorporated herein by reference.

The terms "percent complementarity" or "percent complementary", as used herein in reference to two nucleotide sequences, is similar to the concept of percent identity but refers to the percentage of nucleotides of a query sequence that optimally base-pair or hybridize to nucleotides of a subject sequence when the query and subject sequences are linearly arranged and optimally base paired without secondary folding structures, such as loops, stems or hairpins. Such a percent complementarity may be between two DNA strands, two RNA strands, or a DNA strand and a RNA strand. The "percent complementarity" is calculated by (i) optimally base-pairing or hybridizing the two nucleotide sequences in a linear and fully extended arrangement (i.e., without folding or secondary structures) over a window of comparison, (ii) determining the number of positions that base-pair between the two sequences over the window of comparison to yield the number of complementary positions, (iii) dividing the number of complementary positions by the total number of positions in the window of comparison, and (iv) multiplying this quotient by 100% to yield the percent complementarity of the two sequences. Optimal base pairing of two sequences may be determined based on the known pairings of nucleotide bases, such as G-C, A-T, and A-U, through hydrogen bonding. If the "percent complementarity" is being calculated in relation to a reference sequence without specifying a particular comparison window, then the percent identity is determined by dividing the number of complementary positions between the two linear sequences by the total length of the reference sequence. Thus, for purposes of the present disclosure, when two sequences (query and subject) are optimally base-paired (with allowance for mismatches or non-base-paired nucleotides but without folding or secondary structures), the "percent complementarity" for the query sequence is equal to the number of base-paired positions between the two sequences divided by the total number of positions in the query sequence over its length (or by the number of positions in the query sequence over a comparison window), which is then multiplied by 100%.

As used herein, with respective to a given sequence, a "complement", a "complementary sequence" and a "reverse complement" are used interchangeably. All three terms refer to the inversely complementary sequence of a nucleotide sequence, i.e. to a sequence complementary to a given sequence in reverse order of the nucleotides. As an example, the reverse complement of a nucleotide sequence having the sequence 5'-atggttc-3' is 5'-gaaccat-3'.

As used herein, the term "antisense" refers to DNA or RNA sequences that are complementary to a specific DNA or RNA sequence. Antisense RNA molecules are single-stranded nucleic acids which can combine with a sense RNA strand or sequence or mRNA to form duplexes due to complementarity of the sequences. The term "antisense strand" refers to a nucleic acid strand that is complementary to the "sense" strand. The "sense strand" of a gene or locus is the strand of DNA or RNA that has the same sequence as a RNA molecule transcribed from the gene or locus (with the exception of Uracil in RNA and Thymine in DNA).

As used herein, an "inverted genomic fragment" refers to a genomic segment that is inverted in the genome such that the original sense strand and antisense strand sequences are reversed or switched in the opposite orientation for the entire genomic segment.

As used herein, in the context of a "corresponding endogenous sequence" or a "corresponding endogenous DNA segment," an endogenous sequence or endogenous DNA segment is considered to correspond to another sequence or DNA segment (e.g., an non-endogenous, introduced or inserted sequence or DNA segment) when the sequences or DNA segments share sufficient sequence homology, identity, or complementarity.

The term "operably linked" refers to a functional linkage between a promoter or other regulatory element and an associated transcribable DNA sequence or coding sequence of a gene (or transgene), such that the promoter, etc., operates or functions to initiate, assist, affect, cause, and/or promote the transcription and expression of the associated transcribable DNA sequence or coding sequence, at least in certain cell(s), tissue(s), developmental stage(s), and/or condition(s). Two transcribable DNA sequences can also be "operably linked" to each other if their transcription is subject to the control of a common promoter or other regulatory element. In an aspect, a promoter is selected from the group consisting of a constitutive promoter, an inducible promoter, a tissue-specific promoter, and a tissue-preferred promoter. In an aspect, a promoter is a native promoter.

As used herein, an "encoding region" or "coding region" refers to a portion of a polynucleotide that encodes a functional unit or molecule (e.g., without being limiting, a mRNA, protein, or non-coding RNA sequence or molecule). An "encoding region" or "coding region" can contain, for example, one or more exons, one or more introns, a 5'-UTR, a 3'-UTR, or any combination thereof.

As used herein, an "intervening region" or "intervening sequence" refers to a polynucleotide sequence between a physically linked first polynucleotide sequence and second polynucleotide sequence. The intervening sequence may form a loop, and the first and second sequences may hybridize to form a stem, of a stem-loop structure. In one aspect, an intervening region or intervening sequence comprises at least 1, at least 2, at least 3, at least 4, at least 5, at least 10, at least 25, at least 50, at least 100, at least 150, at least 200, at least 250, at least 500, at least 1000, at least 1250, at least 1500, at least 1750, at least 2000, at least 2500, at least 3000, at least 4000, at least 5000, at least 6000, at least 7000, at least 8000, at least 9000, at least 10,000, at least 15,000, at least 20,000, at least 25,000, or at least 50,000 nucleotides. In one aspect, an intervening region or intervening sequence comprises a DNA sequence. In one aspect, an intervening region or intervening sequence comprises an RNA sequence. In one aspect, an intervening region or intervening sequences comprises an endogenous or native nucleic acid sequence. In another aspect, an intervening region or intervening sequences comprises a transgenic or exogenous nucleic acid sequence. In one aspect, an intervening region or intervening sequences comprises an endogenous or native nucleic acid sequence and a transgenic or exogenous nucleic acid sequence.

The term "recombinant" in reference to a polynucleotide (DNA or RNA) molecule, protein, construct, vector, etc., refers to a polynucleotide or protein molecule or sequence that is man-made and not normally found in nature, and/or is present in a context in which it is not normally found in nature, including a polynucleotide (DNA or RNA) molecule, protein, construct, etc., comprising a combination of two or more polynucleotide or protein sequences that would not naturally occur together in the same manner without human intervention, such as a polynucleotide molecule, protein, construct, etc., comprising at least two polynucleotide or protein sequences that are operably linked but heterologous with respect to each other. For example, the term "recombinant" can refer to any combination of two or more DNA or protein sequences in the same molecule (e.g., a plasmid, construct, vector, chromosome, protein, etc.) where such a combination is man-made and not normally found in nature. As used in this definition, the phrase "not normally found in nature" means not found in nature without human introduction. A recombinant polynucleotide or protein molecule, construct, etc., can comprise polynucleotide or protein sequence(s) that is/are (i) separated from other polynucleotide or protein sequence(s) that exist in proximity to each other in nature, and/or (ii) adjacent to (or contiguous with) other polynucleotide or protein sequence(s) that are not naturally in proximity with each other. Such a recombinant polynucleotide molecule, protein, construct, etc., can also refer to a polynucleotide or protein molecule or sequence that has been genetically engineered and/or constructed outside of a cell. For example, a recombinant DNA molecule can comprise any engineered or man-made plasmid, vector, etc., and can include a linear or circular DNA molecule. Such plasmids, vectors, etc., can contain various maintenance elements including a prokaryotic origin of replication and selectable marker, as well as one or more transgenes or expression cassettes perhaps in addition to a plant selectable marker gene, etc.

As used herein, the term "transgene" refers to a recombinant DNA molecule, construct, or sequence comprising a gene and/or transcribable DNA sequence and integrated or inserted into a plant genome.

As used herein, a "transgenic plant" refers to a plant whose genome has been altered by the integration or insertion of a recombinant DNA molecule, construct, cassette or sequence for expression of a non-coding RNA molecule, mRNA and/or protein in the plant. A transgenic plant includes an $R_0$ plant developed or regenerated from an originally transformed plant cell(s) as well as progeny transgenic plants in later generations or crosses from the $R_0$ transgenic plant that comprise the recombinant DNA molecule, construct, cassette or sequence. A plant having an integrated or inserted recombinant DNA molecule, construct, cassette or sequence is considered a transgenic plant even if the plant also has other mutation(s) or edit(s) that would not themselves be considered transgenic.

As used herein, the term "heterologous" can refer broadly to a combination of two or more DNA molecules or sequences, such as a promoter and an associated transcribable DNA sequence, coding sequence, or gene, when such a combination is man-made and not normally found in nature. The term "heterologous" in reference to a promoter or other regulatory sequence in relation to an associated polynucleotide sequence (e.g., a transcribable DNA sequence or coding sequence or gene) is a promoter or regulatory sequence that is not operably linked to such associated polynucleotide sequence in nature—e.g., the promoter or regulatory sequence has a different origin relative to the associated polynucleotide sequence and/or the promoter or regulatory sequence is not naturally occurring in a plant species to be transformed with the promoter or regulatory sequence. For example, a transcribable DNA sequence encoding a non-coding RNA molecule that targets one or more GA oxidase gene(s) for suppression can be operably linked to a heterologous plant-expressible promoter.

As used herein, the term "expression" refers to the process for converting the genetic information of a gene into a functional unit (without being limiting, for example, a mRNA and/or protein or a non-coding RNA molecule).

As used herein, the terms "suppress," "suppression," "inhibit," "inhibition," "inhibiting," and "downregulation" refer to a lowering, reduction or elimination of the expression level of a mRNA and/or protein encoded by a gene in a plant, plant cell, or plant tissue at one or more stage(s) of plant development, as compared to the expression level of such mRNA and/or protein in a wild-type or control plant, cell, or tissue at the same stage(s) of plant development. In an aspect, a polynucleotide provided herein can suppress the expression of a complementary target gene. In another aspect, a non-coding RNA molecule can suppress the expression of a complementary target gene.

As used herein, a "mutation" refers to an insertion, deletion, substitution, duplication, or inversion of one or more nucleotides and/or encoded amino acids as compared to a reference or wild-type nucleotide and/or amino acid sequence, which can be introduced by any suitable mutagenesis or gene editing technique.

Without being limited by any theory, it is presently proposed that the productivity and yield of commercial corn seed production can be increased by using certain combinations of male and female plants. Typically for commercial corn seed production, one inbred line is used as a male corn plant and another inbred line is used as a female corn plant. By placing or juxtaposing one or more (e.g., a population or row(s)) of male inbred plants next to or near one or more (e.g., a population or row(s)) of female inbred plants in an environment (e.g., the field), the male plants can contribute their genetic material (pollen) to the silk of the ears of the female plants to pollinate and fertilize the ears to produce seed (kernels). Since corn plants have both male and female reproductive structures or flowers, plants can be made "female" by removing, detasseling and/or sterilizing the male reproductive structures, flowers or tassels, such that the genetic contribution of pollen from the female plant is minimized or eliminated and the genetic contribution from pollen can be exclusively or nearly exclusively from the "male" plants. By selectively fertilizing the female ears with pollen from the male plants, hybrid corn seed can be produced if the male and female corn plants are different inbred lines. As well known in the art, corn plants grown from hybrid corn seed have increased yield for growers due to heterosis, or hybrid vigor. To improve agronomic practices with corn seed production, the male and female plants can each be planted in groups or rows. The rows of corn plants can be arranged in a regular or irregular pattern. Furthermore, more female corn plants than male corn plants can be planted to increase yield since corn ears and seeds are harvested from the female corn plants.

One limitation on increasing the number of female corn plants to increase seed production, such as by increasing the number of rows of female corn plants and thus the number of harvested ears, is that there needs to be a sufficient number of male plants to fully pollinate the female corn ears. There is a limit to how far pollen can flow or be distributed by wind, etc., with a decreasing amount or concentration of pollen at increasing distances from the male pollen donor. Thus, corn seed production can be effectively achieved with 4:1, 5:2 or 6:2 row arrangements of female and male plants, respectively (e.g., four female rows, followed by one male row, followed by four female rows, etc., or six female rows, followed by two male rows, followed by six female rows, etc.). Without being limited by any theory, greater numbers of female rows may lead to reduced pollination, fertilization, and/or yield, especially for females in the more interior or distant rows relative to the male plants. Other factors can interfere with pollen flow to female corn plants, such as obstruction by neighboring plants. If the female plants have the same or similar height as the male plant, then the neighboring plants themselves can obstruct air and pollen flow to more interior or distant female rows, even after detasseling of the female plants.

Without being limited by any theory, it is presently proposed, however, that pollen flow could be improved and increased to more interior or distant females or female rows if the female corn plants or rows could be made shorter in height relative to the male plants or rows to not obstruct, or lessen the obstruction of, the flow of pollen to the more interior or distant female corn plants. Indeed, it has been observed that the middle two rows of females in a 4:1 configuration in the field of females to males can have a small yield reduction relative to the other two rows of females. Without being limited by any theory, if pollen flow and/or pollen load could be improved or increased, not only could ear pollination and fertilization rates be increased, leading to larger ears and/or reduced ear tip void, but the number of female corn plants and/or rows, relative to the number of male plants, could be increased to increase the number of ears/seeds harvested due to the ability to pollinate and/or fertilize the more interior or distant female corn plants. Thus, alternative row arrangements of female and male plants, such as 5:1 or 6:1, and potentially 7:1, 8:1, 7:2, 8:2, etc., female to male rows, respectively, can be made more effective and productive with improved pollination and/or fertilization of the more interior or distant female corn plants. If the male and female plants are planted in a regular pattern of rows, the male plants may be planted in rows with equal or similar spacing to the other (female) rows, or male plants may alternatively be inter-planted between female rows.

Even though detasseling can reduce the effective plant height of females (to some extent) at the time of pollination, females having a shorter plant height prior to detasseling should allow for improved pollen flow relative female plants having a more normal height due to the greater height differences between the male and female plants and lower obstruction of pollen flow with the shorter females. This benefit can be additionally useful for female plants having male reproductive structures or tassels that are sterilized by chemical treatment without a reduction in plant height due to detasseling. As a result of the improved pollen flow and/or pollen load, the process of seed production could be made more environmentally sustainable due to the ability to produce as much or more seed on a smaller footprint of fewer acres.

Without being limited by any theory, it is further proposed that shorter plant heights of females may decrease light shading of neighboring male plants, and with reduced shading the male plants may have a reduced or eliminated tassel skeletonization (TSK) in comparison to male plants next to female plants having the same or similar plant height. With reduced tassel skeletonization, pollen production or load by or from the male corn plants can be increased. In some prior cases, row arrangements, such as 4:3, 3:2, and 2:2 females to males, have been used to increased pollen load. However, the present system and method can help overcome these hurdles by reducing tassel skeletonization and permitting fewer numbers of male plants or rows of male plants used for seed production due to the higher pollen load produced per male plant. Therefore, without being limited by theory, it is proposed that corn seed production can be increased with shorter females not only by improving pollen flow, but also by increasing pollen load due to reduced tassel skeletonization of the male plants.

According to another aspect of the present disclosure, it is proposed that corn seed production can be increased with shorter females because shorter female plants can exhibit less root and stalk lodging and/or increased standability at or after the normal time of harvest, which may allow for more flexibility in how long corn is left in the field after drying down and/or allow for direct harvesting of hybrid seeds in a production field. These benefits may further enhance the yield and/or efficiency of corn seed production fields in addition to improved pollen flow, reduced skeletonization and higher number of females in the field. In an aspect, hybrid seeds produced here are collected via direct harvesting. In another aspect, shorter female corn plants are left in a corn field post maturity and can afford a much longer time period for harvesting seeds without jeopardizing the eventual seed yield. As used herein, "direct harvesting" refers to the harvesting of crop seeds from plants with a combine harvester in the field with little or no further drying or other processing or desiccation steps prior to seed storage. As used herein, "standability" refers to the ability of a plant to stand upright in a position that enables it to be harvested by standard farm equipment (e.g., a combine harvester). Corn plants with better standability, such as dwarf corn plants, semi-dwarf corn plants, and brachytic corn plants, are resistant to lodging. As used herein, "lodging" can refer to either "stalk lodging" or "root lodging." Stalk lodging occurs when the corn plant stalk is severely bent or broken below the ear. Root lodging occurs when the corn plant is leaning at an angle (e.g., greater than or equal to 45° relative to perpendicular from the ground, or at an angle less than 45° relative to the ground).

In an aspect, a modified corn plant provided herein has improved lodging resistance relative to an unmodified control plant.

According to some embodiments, it is proposed that pollen flow could be further improved or increased by optionally using a fan, blower or other device that increases or directs air flow (collectively, "air flow device"). Such an air flow device(s) could be placed at one or more predetermined distance(s) from a male corn plant(s), such as a row(s) of male corn plants, on one side of such male corn plant(s) and/or row or rows of male corn plants, wherein the female corn plant(s), such as a row(s) of female corn plants, are on the other (or opposite) side of such male corn plant(s) and/or row or rows of male corn plants relative to the air flow device(s). Such an air flow device could be fixed (i.e., stationary) or mobile. For example, a mobile or moveable air flow device may move along or parallel to a row of male plants. According to another embodiment, a pollinating device or vehicle may be used to promote or enhance the efficient release, distribution or spreading of pollen from male plants to female plants. See, e.g., PCT Application Publication No. WO 2018/129302, the entire contents and disclosure of which are incorporated herein by reference.

There are various ways in which a corn plant can be made to have a shorter semi-dwarf plant height. According to many aspects, a corn plant can be made shorter or semi-dwarf relative to a control plant by lowering the level(s) of active GAs in one or more tissue(s) of the plant, such as by suppressing, mutating or editing one or more GA oxidase gene(s) in the corn plant. According to other aspects, a corn plant or plurality of corn plants provided herein can have a mutation or edit in an auxin, brassinosteroid, jasmonic acid, cell cycle regulation, and/or other pathway gene(s) that are known to affect plant height. According to yet other aspects, a female corn plant or plurality of female corn plants provided herein can be made shorter by application of one or more chemistries, such as GA inhibitors, known to affect plant height. Additional information regarding chemistries, such as GA inhibitors, can be found in WO 2017/011791 and U.S. Patent Application Publication Nos. 2019/0014730 and 2019/0014731, which are incorporated herein by reference in their entireties. According to another aspect, a corn plant or plurality of corn plants provided herein can comprise a mutation or mutant allele in one or more loci or genes that have been associated with a short stature phenotype in corn, such as one or more of the following: anther ear 1 (An1), brachytic 1 (Br1), brevis plant 1 (Bv1) or brachytic 3 (br3), crinkly 4 (Cr4), compact plant 2 (Ct2), dwarf plant 1 (d1), dwarf plant 8 (d8), dwarf plant 9 (d9), nana plant 1 (Na1), nana plant 2 (Na2), non-chromosomal stripe 3 (Nsc3), narrow leaf dwarf 1 (N1d1), reduced plant 1 (Rd1), semi-dwarf/(Sdw1), semi-dwarf 2 (Sdw2), tangled/(Tan1), terminal ear 1 (Te1), and vanishing tassel 2 (Vt2).

In an aspect, a corn plant(s) is homozygous for one or more mutation(s) and/or edit(s) in one of the foregoing native corn genes. In an aspect, a corn plant is biallelic for a first mutation and/or edit and a second mutation and/or edit in one of the foregoing native corn genes.

Gibberellins (gibberellic acids or GAs) are plant hormones that regulate a number of major plant growth and developmental processes. Manipulation of GA levels in semi-dwarf wheat, rice and sorghum plant varieties led to increased yield and reduced lodging in these cereal crops during the 20$^{th}$ century, which was largely responsible for the Green Revolution. However, successful yield gains in other cereal crops, such as corn, have not been realized through manipulation of the GA pathway. Corn or maize is unique among the grain-producing grasses in that it forms separate male (tassel) and female (ear) inflorescences, and mutations in the GA pathway in corn have been shown to negatively impact reproductive development. Indeed, some mutations in the GA pathway genes in corn have been associated with various off-types that are incompatible with yield, which has led researchers away from finding semi-dwarf, high-yielding corn varieties via manipulation of the GA pathway.

Despite these prior difficulties in achieving higher grain yields in corn through manipulation of the GA pathway, PCT Application No. PCT/US2017/047405 describes a way to manipulate active GA levels in corn plants in a manner that reduces overall plant height and stem internode length and increases resistance to lodging, but does not cause the reproductive off-types previously associated with mutations of the GA pathway in corn. Further evidence indicates that these short stature or semi-dwarf corn plants with reduced GA levels can also have one or more additional yield and/or stress tolerance traits, including increased stem diameter, reduced green snap, deeper roots, increased leaf area, earlier canopy closure, higher stomatal conductance, lower ear height, increased foliar water content, improved drought tolerance, increased nitrogen use efficiency, increased water use efficiency, reduced anthocyanin content and area in leaves under normal or nitrogen or water limiting stress conditions, increased ear weight, increased kernel number, increased kernel weight, increased yield, and/or increased harvest index.

Active or bioactive gibberellic acids (i.e., "active gibberellins" or "active GAs") are known in the art for a given plant species, as distinguished from inactive GAs. For example, active GAs in corn and higher plants include the following: GA1, GA3, GA4, and GA7. Thus, an "active GA-producing tissue" is a plant tissue that produces one or more active GAs. In an aspect, a modified corn plant comprises a level of one or more active GAs in at least one internode tissue of a stem or stalk that is at least 1%, at least 2%, at least 2.5%, at least 3%, at least 4%, at least 5%, at least 6%, at least 7%, at least 8%, at least 9%, at least 10%, at least 11%, at least 12%, at least 13%, at least 14%, at least 15%, at least 20%, at least 25%, at least 30%, at least 35%, at least 40%, at least 45%, or at least 50% lower than the level of the one or more active GAs in the same internode tissue of an unmodified control plant. In an aspect, a modified corn plant provided herein comprises a lower level of one or more active GAs in at least one internode tissue of a stem or stalk as compared to the same internode tissue of an unmodified control plant.

Certain biosynthetic enzymes (e.g., GA20 oxidase and GA3 oxidase) and catabolic enzymes (e.g., GA2 oxidase) in the GA pathway participate in GA synthesis and degradation, respectively, to affect active GA levels in plant tissues. Thus, in addition to suppression of certain GA20 oxidase genes, it is further proposed that suppression of a GA3 oxidase gene in a constitutive or tissue-specific or tissue-preferred manner can also produce corn plants having a short stature phenotype and increased lodging resistance, with possible increased yield, but without off-types in the ear.

Without being bound by theory, it is proposed that incomplete suppression of GA20 or GA3 oxidase gene(s) and/or targeting of a subset of one or more GA oxidase gene(s) can be effective in achieving a short stature, semi-dwarf phenotype with increased resistance to lodging, but without reproductive off-types in the ear. It is further proposed, without being limited by theory, that restricting the suppression of GA20 and/or GA3 oxidase gene(s) to certain active GA-producing tissues, such as the vascular and/or leaf tissues of the plant, can be sufficient to produce a short-stature plant with increased lodging resistance, but without significant off-types in reproductive tissues. Expression of a GA20 or GA3 oxidase suppression element in a tissue-specific or tissue-preferred manner can be sufficient and effective at producing plants with the short stature phenotype, while avoiding potential off-types in reproductive tissues that were previously observed with GA mutants in corn (e.g., by avoiding or limiting the suppression of the GA20 oxidase gene(s) in those reproductive tissues). For example, GA20 and/or GA3 oxidase gene(s) can be targeted for suppression using a vascular promoter, such as a rice tungro bacilliform virus (RTBV) promoter, which drives expression in vascular tissues of plants. The expression pattern of the RTBV promoter is enriched in vascular tissues of corn plants relative to non-vascular tissues, which is sufficient to produce a semi-dwarf phenotype in corn plants when operably linked to a suppression element targeting GA20 and GA3 oxidase gene(s). Lowering of active GA levels in tissue(s) of a corn plant that produce active GAs can reduce plant height and increase lodging resistance, and off-types can be avoided in those plants if active GA levels are not also significantly impacted or lowered in reproductive tissues, such as the developing female organ or ear of the plant. If active GA levels could be reduced in the stalk, stem, or internode(s) of corn or cereal plants without significantly affecting GA levels in reproductive tissues (e.g., the female or male reproductive organs or inflorescences), then corn or cereal plants having reduced plant height and increased lodging resistance could be created without off-types in the reproductive tissues of the plant.

Without being limited by theory, it is further proposed that short stature, semi-dwarf phenotypes in corn plants can result from a sufficient level of expression of a suppression construct targeting certain GA oxidase gene(s) in active GA-producing tissue(s) of the plant. For targeted suppression of certain GA20 oxidase genes in corn, restricting the pattern of expression to avoid reproductive ear tissues may not be necessary to avoid reproductive off-types in the developing ear. However, expression of a GA20 oxidase suppression construct at low levels, and/or in a limited number of plant tissues, can be insufficient to cause a significant short stature, semi-dwarf phenotype. Given that the observed semi-dwarf phenotype with targeted GA20 oxidase suppression is the result of shortening the stem internodes of the plant, it was surprisingly found that suppression of GA20 oxidase genes in at least some stem tissues was not sufficient to cause shortening of the internodes and reduced plant height. Without being bound by theory, it is proposed that suppression of certain GA oxidase gene(s) in tissue(s) and/or cell(s) of the plant where active GAs are produced, and not necessarily in stem or internode tissue(s), may be sufficient to produce semi-dwarf plants, even though the short stature trait is due to shortening of the stem internodes. Given that GAs can migrate through the vasculature of the plant, manipulating GA oxidase genes in plant tissue(s) where active GAs are produced can result in a short stature, semi-dwarf plant, even though this can be largely achieved by suppressing the level of active GAs produced in non-stem tissues (i.e., away from the site of action in the stem where reduced internode elongation leads to the semi-dwarf phenotype). Indeed, suppression of certain GA20 oxidase genes in leaf tissues causes a moderate semi-dwarf phenotype in corn plants. Given that expression of a GA20 oxidase suppression construct with several different "stem" promoters did not produce the semi-dwarf phenotype in corn, it is noteworthy that expression of the same GA20 oxidase suppression construct with a vascular promoter was effective at consistently producing the semi-dwarf phenotype with a high degree of penetrance across events and germplasms. A semi-dwarf phenotype was also observed with expression of the same GA20 oxidase suppression construct using other vascular promoters and with various constitutive promoters without any observable off-types.

In an aspect, a corn plant or plurality of corn plants provided herein can each comprise a recombinant DNA construct or polynucleotide sequence, where the recombinant DNA construct or polynucleotide sequence comprises a transcribable DNA sequence encoding a non-coding RNA molecule that targets at least one endogenous GA20 or GA3 oxidase gene for suppression. In another aspect, a corn plant provided herein can comprise suppressed GA3 oxidase gene expression in one or more tissues as compared to a wild-type control plant. In another aspect, a corn plant provided herein can comprise suppressed GA20 oxidase gene expression in one or more tissues as compared to a wild-type control plant. In another aspect, a corn plant provided herein can comprise a mutation at or near an endogenous GA oxidase gene, where the expression level of the endogenous GA oxidase gene is reduced or eliminated in the corn plant, and where the corn plant has a shorter plant height as compared to a wild-type control plant. In an aspect, a corn plant provided herein can comprise a recombinant polynucleotide capable of suppressing expression of one or more GA20 oxidase and/or GA3 oxidase gene(s) and/or mRNA(s) transcribed therefrom. Alternatively, a corn plant provided herein can comprise one or more mutation(s) or edit(s) in one or more GA20 oxidase and/or GA3 oxidase gene(s). In an aspect, a female corn plant provided herein can comprise a mutation in a GA20 oxidase locus or gene as compared to a wildtype GA20 oxidase locus or gene. In an aspect, a corn plant provided herein is homozygous (or biallelic) for a mutation or an edit in one or more GA20 oxidase loci or genes as compared to a wildtype GA20 oxidase locus or gene. In an aspect, a corn plant provided herein is homozygous (or biallelic) for a mutation or an edit in a GA20 oxidase_3 gene as compared to a wildtype GA20 oxidase_3 gene. In an aspect, a corn plant provided herein is homozygous (or biallelic) for a mutation or an edit in a GA20 oxidase_5 gene as compared to a wildtype GA20 oxidase_5 gene. In another aspect, a corn plant provided herein is heterozygous for a mutation or an edit in one or more GA20 oxidase loci or genes as compared to a wildtype GA20 oxidase locus or gene. In an aspect, a corn plant provided herein is heterozygous for a mutation or an edit in a GA20 oxidase_3 gene as compared to a wildtype GA20 oxidase_3 gene. In an aspect, a corn plant provided herein is heterozygous for a mutation or an edit in a GA20 oxidase_5 gene as compared to a wildtype GA20 oxidase_5 gene. In another aspect, a corn plant provided herein can comprise a mutation in a GA3 oxidase locus or gene as compared to a wildtype GA3 oxidase locus or gene. In an aspect, a corn plant provided herein is homozygous (or biallelic) for a mutation or an edit in one or more GA3 oxidase loci or genes as compared to a wildtype GA3 oxidase locus or gene. In another aspect, a corn plant provided herein is heterozygous for a mutation or an edit in a one or more GA3 oxidase loci or genes as compared to a wildtype GA3 oxidase locus or gene. In another aspect, a corn plant provided herein can comprise a heterologous polynucleotide capable of suppressing expression of a GA20 oxidase gene or an mRNA transcribed therefrom. Additional details about altering the expression of GA20 and/or GA3 oxidase gene(s) through suppression, mutation, or editing of those gene(s) can be found in PCT Application No. PCT/US2017/047405, the entire contents and disclosure of which is incorporated herein by reference.

In an aspect, a modified corn plant, or plant part thereof, is homozygous for a mutant allele at an endogenous GA oxidase locus. In an aspect, a modified corn plant, or plant part thereof, is biallelic for a first mutant allele and a second mutant allele at an endogenous GA oxidase locus. In an aspect, a modified corn plant, or plant part thereof, is heterozygous for a mutant allele at an endogenous GA oxidase locus. In an aspect, a modified corn plant, or plant part thereof, is homozygous for a mutant allele at an endogenous GA20 oxidase locus. In an aspect, a modified corn plant, or plant part thereof, is biallelic for a first mutant allele and a second mutant allele at an endogenous GA20 oxidase locus. In an aspect, a modified corn plant, or plant part thereof, is heterozygous for a mutant allele at an endogenous GA20 oxidase locus. In an aspect, a modified corn plant, or plant part thereof, is homozygous for a mutant allele at an endogenous GA20 oxidase_5 locus. In an aspect, a modified corn plant, or plant part thereof, is biallelic for a first mutant allele and a second mutant allele at an endogenous GA20 oxidase_5 locus. In an aspect, a modified corn plant, or plant part thereof, is heterozygous for a mutant allele at an endogenous GA20 oxidase_5 locus. In an aspect, a modified corn plant, or plant part thereof, is homozygous for a mutant allele at an endogenous GA20 oxidase_3 locus. In an aspect, a modified corn plant, or plant part thereof, is biallelic for a first mutant allele and a second mutant allele at an endogenous GA20 oxidase_3 locus. In an aspect, a modified corn plant, or plant part thereof, is heterozygous for a mutant allele at an endogenous GA20 oxidase_3 locus. In an aspect, a modified corn plant, or plant part thereof, is homozygous for a mutant allele at an endogenous GA3 oxidase locus. In an aspect, a modified corn plant, or plant part thereof, is biallelic for a first mutant allele and a second mutant allele at an endogenous GA3 oxidase locus. In an aspect, a modified corn plant, or plant part thereof, is heterozygous for a mutant allele at an endogenous GA3 oxidase locus.

By targeting a subset of one or more endogenous GA3 or GA20 oxidase genes for suppression within a plant, a more pervasive pattern of expression (e.g., with a constitutive promoter) can be used to produce semi-dwarf plants without significant reproductive off-types and/or other undesirable traits in the plant, even with expression of the suppression construct in reproductive tissue(s). Indeed, suppression elements and constructs are provided herein that selectively target the GA20 oxidase_3 and/or GA20 oxidase_5 genes for suppression, which can be operably linked to a vascular, leaf and/or constitutive promoter.

As introduced above, instead of suppressing one or more GA oxidase gene(s), active GA levels can also be reduced in a corn plant by mutation or editing of one or more GA20 and/or GA3 oxidase gene(s).

Corn has a family of at least nine GA20 oxidase genes that includes GA20 oxidase_1, GA20 oxidase_2, GA20 oxidase_3, GA20 oxidase_4, GA20 oxidase_5, GA20 oxidase_6, GA20 oxidase_7, GA20 oxidase_8, and GA20 oxidase_9. However, there are only two GA3 oxidases in corn, GA3 oxidase_1 and GA3 oxidase_2. The DNA and protein sequences by SEQ ID NOs for each of these GA20 oxidase genes are provided in Table 1, and the DNA and protein sequences by SEQ ID NOs for each of these GA3 oxidase genes are provided in Table 2.

In an aspect, a corn plant provided herein is homozygous (or biallelic) for a mutation or an edit in a GA20 oxidase_5 locus or gene as compared to a wildtype GA20 oxidase_5 locus or gene and homozygous (or biallelic) for a mutation or an edit in a GA20 oxidase_3 locus or gene as compared to a wildtype GA20 oxidase_3 locus or gene. In an aspect, a corn plant provided herein is homozygous (or biallelic) for a mutation or an edit in a GA20 oxidase_5 locus or gene as compared to a wildtype GA20 oxidase_5 locus or gene and heterozygous for a mutation or an edit in a GA20 oxidase_3 locus or gene as compared to a wildtype GA20 oxidase_3 locus or gene. In an aspect, a corn plant provided herein is heterozygous for a mutation or an edit in a GA20 oxidase_5 locus or gene as compared to a wildtype GA20 oxidase_5 locus or gene and homozygous (or biallelic) for a mutation or an edit in a GA20 oxidase_3 locus or gene as compared to a wildtype GA20 oxidase_3 locus or gene. See, e.g., U.S. Provisional Patent Application Nos. 62/631,412; 62/631,416; and 62/710,302; the contents and disclosures of which are incorporated herein by reference in their entireties.

TABLE 1

DNA and protein sequences by sequence identifier for GA20 oxidase genes in corn.

| GA20 oxidase Gene | cDNA | Coding Sequence (CDS) | Protein |
|---|---|---|---|
| GA20 oxidase_1 | SEQ ID NO: 1 | SEQ ID NO: 2 | SEQ ID NO: 3 |
| GA20 oxidase_2 | SEQ ID NO: 4 | SEQ ID NO: 5 | SEQ ID NO: 6 |
| GA20 oxidase_3 | SEQ ID NO: 7 | SEQ ID NO: 8 | SEQ ID NO: 9 |
| GA20 oxidase_4 | SEQ ID NO: 10 | SEQ ID NO: 11 | SEQ ID NO: 12 |
| GA20 oxidase_5 | SEQ ID NO: 13 | SEQ ID NO: 14 | SEQ ID NO: 15 |
| GA20 oxidase_6 | SEQ ID NO: 16 | SEQ ID NO: 17 | SEQ ID NO: 18 |
| GA20 oxidase_7 | SEQ ID NO: 19 | SEQ ID NO: 20 | SEQ ID NO: 21 |
| GA20 oxidase_8 | SEQ ID NO: 22 | SEQ ID NO: 23 | SEQ ID NO: 24 |
| GA20 oxidase_9 | SEQ ID NO: 25 | SEQ ID NO: 26 | SEQ ID NO: 27 |

TABLE 2

DNA and protein sequences by sequence identifier for GA3 oxidase genes in corn.

| GA3 oxidase Gene | cDNA | Coding Sequence (CDS) | Protein |
|---|---|---|---|
| GA3 oxidase_1 | SEQ ID NO: 28 | SEQ ID NO: 29 | SEQ ID NO: 30 |
| GA3 oxidase_2 | SEQ ID NO: 31 | SEQ ID NO: 32 | SEQ ID NO: 33 |

The genomic DNA sequence of GA20 oxidase_3 is provided in SEQ ID NO: 34, and the genomic DNA sequence of GA20 oxidase_5 is provided in SEQ ID NO: 35. For the GA20 oxidase_3 gene, SEQ ID NO: 34 provides 3000 nucleotides upstream of the GA20 oxidase_3 5'-UTR; nucleotides 3001-3096 correspond to the 5'-UTR; nucleotides 3097-3665 correspond to the first exon; nucleotides 3666-3775 correspond to the first intron; nucleotides 3776-4097 correspond to the second exon; nucleotides 4098-5314 correspond to the second intron; nucleotides 5315-5584 correspond to the third exon; and nucleotides 5585-5800 correspond to the 3'-UTR. SEQ ID NO: 34 also provides 3000 nucleotides downstream of the end of the 3'-UTR (nucleotides 5801-8800).

For the GA20 oxidase_5 gene, SEQ ID NO: 35 provides 3000 nucleotides upstream of the GA20 oxidase_5 start codon (nucleotides 1-3000); nucleotides 3001-3791 correspond to the first exon; nucleotides 3792-3906 correspond to the first intron; nucleotides 3907-4475 correspond to the second exon; nucleotides 4476-5197 correspond to the second intron; nucleotides 5198-5473 correspond to the third exon; and nucleotides 5474-5859 correspond to the 3'-UTR. SEQ ID NO: 35 also provides 3000 nucleotides downstream of the end of the 3'-UTR (nucleotides 5860-8859).

The genomic DNA sequence of GA3 oxidase_1 is provided in SEQ ID NO: 36, and the genomic DNA sequence of GA3 oxidase_2 is provided in SEQ ID NO: 37. For the GA3 oxidase_1 gene, nucleotides 1-29 of SEQ ID NO: 36 correspond to the 5'-UTR; nucleotides 30-514 of SEQ ID NO: 36 correspond to the first exon; nucleotides 515-879 of SEQ ID NO: 36 correspond to the first intron; nucleotides 880-1038 of SEQ ID NO: 36 correspond to the second exon; nucleotides 1039-1158 of SEQ ID NO: 36 correspond to the second intron; nucleotides 1159-1663 of SEQ ID NO: 36 correspond to the third exon; and nucleotides 1664-1788 of SEQ ID NO: 36 correspond to the 3'-UTR. For the GA3 oxidase_2 gene, nucleotides 1-38 of SEQ ID NO: 37 correspond to the 5-UTR; nucleotides 39-532 of SEQ ID NO: 37 correspond to the first exon; nucleotides 533-692 of SEQ ID NO: 37 correspond to the first intron; nucleotides 693-851 of SEQ ID NO: 37 correspond to the second exon; nucleotides 852-982 of SEQ ID NO: 37 correspond to the second intron; nucleotides 983-1445 of SEQ ID NO: 37 correspond to the third exon; and nucleotides 1446-1698 of SEQ ID NO: 37 correspond to the 3'-UTR.

In addition to phenotypic observations with targeting the GA20 oxidase_3 and/or GA20 oxidase_5 gene(s), or the GA3 oxidase_1 and/or GA3 oxidase_2 gene(s), for suppression, a semi-dwarf phenotype is also observed with suppression of the GA20 oxidase_4 gene. The genomic DNA sequence of GA20 oxidase_4 is provided in SEQ ID NO: 38. For the GA oxidase_4 gene, SEQ ID NO: 38 provides nucleotides 1-1416 upstream of the 5'-UTR; nucleotides 1417-1543 of SEQ ID NO: 38 correspond to the 5'-UTR; nucleotides 1544-1995 of SEQ ID NO: 38 correspond to the first exon; nucleotides 1996-2083 of SEQ ID NO: 38 correspond to the first intron; nucleotides 2084-2411 of SEQ ID NO: 38 correspond to the second exon; nucleotides 2412-2516 of SEQ ID NO: 38 correspond to the second intron; nucleotides 2517-2852 of SEQ ID NO: 38 correspond to the third exon; nucleotides 2853-3066 of SEQ ID NO: 38 correspond to the 3'-UTR; and nucleotides 3067-4465 of SEQ ID NO: 38 corresponds to genomic sequence downstream of to the 3'-UTR.

In an aspect, the present disclosure provides a corn plant or plurality of corn plants each comprising a recombinant DNA construct or polynucleotide sequence comprising a transcribable DNA sequence encoding a non-coding RNA molecule, wherein the non-coding RNA molecule comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or corn cell, the endogenous GA oxidase protein being at least 80%, at least 85%, at least 90%, at least 95%, at least 96%, at least 97%, at least 98%, at least 99%, at least 99.5%, or 100% identical to SEQ ID NO: 9, 12, 15, 30, and/or 33, and wherein the transcribable DNA sequence is operably linked to a plant-expressible promoter, which can be heterologous with respect to the transcribable DNA sequence and/or the corn plant.

Recombinant DNA constructs and transgenic corn plants are provided herein comprising a GA20 or GA3 oxidase suppression element or sequence operably linked to a plant expressible promoter, which can be a constitutive or tissue-specific or tissue-preferred promoter. Such a tissue-specific or tissue-preferred promoter can drive expression of its associated GA oxidase suppression element or sequence in one or more active GA-producing tissue(s) of the plant to suppress or reduce the level of active GAs produced in those tissue(s). Such a tissue-specific or tissue-preferred promoter can drive expression of its associated GA oxidase suppression construct or transgene during one or more vegetative stage(s) of development. Such a tissue-specific or tissue-preferred promoter can also have little or no expression in one or more cell(s) or tissue(s) of the developing female organ or ear of the plant to avoid the possibility of off-types in those reproductive tissues.

As used herein, a "plant-expressible promoter" refers to a promoter that drives, causes, or initiates expression of a transcribable DNA sequence or transgene operably linked to such promoter in one or more plant cells or tissues, such as one or more cells or tissues of a corn plant. In an aspect, a plant-expressible promoter is a constitutive promoter. In another aspect, a plant-expressible promoter is a vascular promoter. As used herein, a "vascular promoter" refers to a plant-expressible promoter that drives, causes or initiates expression of a transcribable DNA sequence or transgene operably linked to such promoter in one or more vascular tissue(s) of the plant, even if the promoter is also expressed in other non-vascular plant cell(s) or tissue(s). Such vascular tissue(s) can comprise one or more of the phloem, vascular parenchymal, and/or bundle sheath cell(s) or tissue(s) of the plant. A "vascular promoter" is distinguished from a constitutive promoter in that it has a regulated and relatively more limited pattern of expression that includes one or more vascular tissue(s) of the plant. A vascular promoter includes both vascular-specific promoters and vascular-preferred promoters. In another aspect, a plant-expressible promoter is a leaf promoter. As used herein, a "leaf promoter" refers to a plant-expressible promoter that drives, causes or initiates expression of a transcribable DNA sequence or transgene operably linked to such promoter in one or more leaf tissue(s) of the plant, even if the promoter is also expressed in other non-leaf plant cell(s) or tissue(s). A leaf promoter includes both leaf-specific promoters and leaf-preferred promoters. A "leaf promoter" is distinguished from a vascular promoter in that it is expressed more predominantly or exclusively in leaf tissue(s) of the plant relative to other plant tissues, whereas a vascular promoter is expressed in vascular tissue(s) more generally including vascular tissue(s) outside of the leaf, such as the vascular tissue(s) of the stem, or stem and leaves, of the plant.

Promoters that drive enhanced expression in certain tissues of the plant relative to other plant tissues are referred to as "tissue-enhanced" or "tissue-preferred" promoters. Thus, a "tissue-preferred" promoter causes relatively higher or preferential or predominant expression in a specific tissue(s) of the plant, but with lower levels of expression in other tissue(s) of the plant. Promoters that express within a specific tissue(s) of the plant, with little or no expression in other plant tissues, are referred to as "tissue-specific" promoters.

A non-limiting exemplary plant-expressible promoter is the RTBV promoter. In an aspect, a plant-expressible promoter is an RTBV promoter. In another aspect, a plant expressible promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 39, SEQ ID NO: 40, or a functional portion thereof.

Non-limiting exemplary vascular promoters include a sucrose synthase promoter, a sucrose transporter promoter, a Sh1 promoter, Commelina yellow mottle virus (CoYMV) promoter, a wheat dwarf geminivirus (WDV) large intergenic region (LIR) promoter, a maize streak geminivirus (MSV) coat protein (CP) promoter, a rice yellow stripe 1 (YS1)-like promoter, and a rice yellow stripe 2 (OsYSL2) promoter. In an aspect, a vascular promoter is selected from the group consisting of a sucrose synthase promoter, a sucrose transporter promoter, a Sh1 promoter, Commelina yellow mottle virus (CoYMV) promoter, a wheat dwarf geminivirus (WDV) large intergenic region (LIR) promoter, a maize streak geminivirus (MSV) coat protein (CP) promoter, a rice yellow stripe 1 (YS1)-like promoter, a rice yellow stripe 2 (OsYSL2) promoter, and functional portions thereof. In an aspect, a vascular promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 41, SEQ ID NO: 42, SEQ ID NO: 43, SEQ ID NO: 44, SEQ ID NO: 45, or a functional portion thereof.

Non-limiting exemplary leaf promoters include a RuBisCO promoter, a PPDK promoter, a FDA promoter, a Nadh-Gogat promoter, a chlorophyll a/b binding protein gene promoter, a phosphoenolpyruvate carboxylase (PEPC) promoter, and a Myb gene promoter. In an aspect, a leaf promoter is selected from the group consisting of a RuBisCO promoter, a PPDK promoter, a FDA promoter, a Nadh-Gogat promoter, a chlorophyll a/b binding protein gene promoter, a phosphoenolpyruvate carboxylase (PEPC) promoter, a Myb gene promoter, and functional portions thereof. In an aspect, a leaf promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 46, SEQ ID NO: 47, SEQ ID NO: 48, or a functional portion thereof.

Non-limiting exemplary constitutive promoters include an actin promoter, a CaMV 35S or 19S promoter, a plant ubiquitin promoter, a plant Gos2 promoter, a FMV promoter, a CMV promoter, a MMV promoter, a PCLSV promoter, an Emu promoter, a tubulin promoter, a nopaline synthase promoter, an octopine synthase promoter, a mannopine synthase promoter, and a maize alcohol dehydrogenase. In an aspect, a constitutive promoter is selected from the group consisting of an actin promoter, a CaMV 35S or 19S promoter, a plant ubiquitin promoter, a plant Gos2 promoter, a FMV promoter, a CMV promoter, a MMV promoter, a PCLSV promoter, an Emu promoter, a tubulin promoter, a nopaline synthase promoter, an octopine synthase promoter, a mannopine synthase promoter, a maize alcohol dehydrogenase, or functional portions thereof. In an aspect, a constitutive promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, or a functional portion thereof.

In another aspect, the present disclosure provides a corn plant or plurality of corn plants each comprising a recombinant DNA construct or polynucleotide sequence comprising a transcribable DNA sequence encoding a non-coding RNA molecule, wherein the non-coding RNA molecule comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase gene having at least 80%, at least 85%, at least 90%, at least 95%, at least 96%, at least 97%, at least 98%, at least 99%, at least 99.5%, or 100% identical to SEQ ID NO: 9, 12, 15, 30, and/or 33, and wherein the transcribable DNA sequence is operably linked to a plant-expressible promoter, which can be heterologous with respect to the transcribable DNA sequence and/or the corn plant.

As provided above, a corn plant or plant part can comprise a first expression cassette comprising a first sequence encoding a non-coding RNA molecule that targets one or more GA20 or GA3 oxidase gene(s) for suppression. In an aspect, the non-coding RNA molecule can target one or more GA20 oxidase gene(s) for suppression, such as a GA20 oxidase_3 gene, a GA20 oxidase_4 gene, a GA20 oxidase_5 gene, or any combination thereof. According to some embodiments, the first expression cassette comprises a first transcribable DNA sequence encoding a non-coding RNA targeting a GA20 oxidase_3 gene for suppression. According to other embodiments, the first expression cassette comprises a first transcribable DNA sequence encoding a non-coding RNA targeting a GA20 oxidase_5 gene for suppression. According to yet further embodiments, the first expression cassette comprises a first transcribable DNA sequence encoding a non-coding RNA that targets both the GA20 oxidase_3 gene and the GA20 oxidase_5 gene for suppression. In addition to targeting a mature mRNA sequence (including either or both of the untranslated or exonic sequences), a non-coding RNA molecule can also target the intronic sequences of a GA20 oxidase gene or transcript.

For suppression of a GA20 oxidase_3 gene, a first transcribable DNA sequence comprises a sequence that is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence selected from the group consisting of SEQ ID NO: 7, SEQ ID NO: 8, and SEQ ID NO: 34.

For suppression of a GA20 oxidase_4 gene, a first transcribable DNA sequence comprises a sequence that is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence selected from the group consisting of SEQ ID NO: 10, SEQ ID NO: 11, and SEQ ID NO: 38.

For suppression of a GA20 oxidase_5 gene, a first transcribable DNA sequence comprises a sequence that is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence selected from the group consisting of SEQ ID NO: 13, SEQ ID NO: 14, and SEQ ID NO: 35.

For suppression of a GA20 oxidase_3 gene and a GA20 oxidase_5 gene, a transcribable DNA sequence comprises a sequence that is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence selected from the group consisting of SEQ ID NO: 7, SEQ ID NO: 8, and SEQ ID NO: 34; and the transcribable DNA sequence comprises a sequence that is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence selected from the group consisting of SEQ ID NO: 13, SEQ ID NO: 14, and SEQ ID NO: 35.

In another aspect, a first expression cassette comprises a first transcribable DNA sequence encoding a non-coding RNA targeting a GA3 oxidase gene(s) for suppression in corn, such as a GA3 oxidase_1 gene or a GA3 oxidase_2 gene. In another aspect, a first transcribable DNA sequence encoding a non-coding RNA targets both the GA3 oxidase_1 gene and the GA3 oxidase_2 gene for suppression. In addition to targeting a mature mRNA sequence (including either or both of the untranslated or exonic sequences), a non-coding RNA molecule can also target the intronic sequences of a GA3 oxidase gene or transcript.

For suppression of a GA3 oxidase_1 gene, a first transcribable DNA sequence comprises a sequence that is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence selected from the group consisting of SEQ ID NO: 28, SEQ ID NO: 29, and SEQ ID NO: 36.

For suppression of a GA3 oxidase_2 gene, a first transcribable DNA sequence comprises a sequence that is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence selected from the group consisting of SEQ ID NO: 31, SEQ ID NO: 32, and SEQ ID NO: 37.

For suppression of a GA3 oxidase_1 gene and a GA3 oxidase_2 gene, a transcribable DNA sequence comprises a sequence that is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence selected from the group consisting of SEQ ID NO: 28, SEQ ID NO: 29, and SEQ ID NO: 36; and the transcribable DNA sequence comprises a sequence that is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence selected from the group consisting of SEQ ID NO: 31, SEQ ID NO: 32 and SEQ ID NO: 37.

In an aspect, a mutant allele of an endogenous GA20 oxidase_3 locus comprises a DNA segment inserted into the endogenous GA20 oxidase_3 locus, where the DNA segment encodes an antisense RNA sequence that is at least 70%, at least 80%, at least 90%, at least 91%, at least 92%, at least 93%, at least 94%, at least 95%, at least 96%, at least 97%, at least 98%, at least 99%, or 100% complementary to at least 20, at least 30, at least 40, at least 50, at least 100, at least 200, at least 300, at least 400, at least 500, at least 600, at least 700, at least 800, at least 900, or at least 1000 consecutive nucleotides of one or more of SEQ ID NOs: 182-184 and 186-188, and where the mutant allele of the endogenous GA20 oxidase_3 locus produces an RNA transcript comprising the antisense RNA sequence.

In an aspect, a mutant allele of an endogenous GA20 oxidase_5 locus comprises a DNA segment inserted into the endogenous GA20 oxidase_5 locus, where the DNA segment encodes an antisense RNA sequence that is at least 70%, at least 80%, at least 90%, at least 91%, at least 92%, at least 93%, at least 94%, at least 95%, at least 96%, at least 97%, at least 98%, at least 99%, or 100% complementary to at least 20, at least 30, at least 40, at least 50, at least 100, at least 200, at least 300, at least 400, at least 500, at least 600, at least 700, at least 800, at least 900, or at least 1000 consecutive nucleotides of one or more of SEQ ID NOs: 182-184 and 186-188, and where the mutant allele of the endogenous GA20 oxidase_5 locus produces a RNA transcript comprising the antisense RNA sequence.

In an aspect, a mutant allele of the endogenous GA20 oxidase_3 locus suppresses the expression of a wild-type allele of the endogenous GA20 oxidase_3 locus, a wild-type allele of the endogenous GA20 oxidase_5 locus, or both. In an aspect, a mutant allele of the endogenous GA20 oxidase_5 locus suppresses the expression of a wild-type allele of the endogenous GA20 oxidase_3 locus, a wild-type allele of the endogenous GA20 oxidase_5 locus, or both. In an aspect, a mutant allele comprises a deletion of at least one portion of an endogenous GA20 oxidase_3 locus.

Without being bound by any scientific theory, if a genomic region between the neighboring Zm.GA20ox5 and Zm.SAMT genes (including possibly all or part of those genes) is deleted, then the endogenous Zm.SAMT gene promoter can drive expression of an antisense RNA transcript through all or part of the Zm.GA20ox5 gene that can hybridize to a separate RNA transcript expressed from one or both of the copies or alleles of the Zm.GA20ox5 and/or Zm.GA20ox3 gene(s). Thus, a mutant allele having a deletion between the Zm.GA20ox5 and Zm.SAMT genes can behave as a dominant negative mutation or allele by causing suppression or silencing of one or both (wild-type and/or mutant) copies or alleles of the endogenous Zm.GA20ox5 gene, in addition to possible further suppression or silencing of one or both copies or alleles of the endogenous Zm.GA20ox3 gene.

According to aspects of the present disclosure, a mutant or edited allele of the endogenous GA20 oxidase_5 (GA20ox5) gene or locus is provided comprising a deletion between the neighboring Zm.GA20ox5 and Zm.SAMT genes, such that an antisense RNA molecule that is complementary to all or part of the coding sequence of the GA20ox5 gene may be transcribed under the control of the endogenous Zm.SAMTgene promoter. It is contemplated that the antisense RNA molecule transcribed from the mutant or edited allele of the endogenous GA20 oxidase_5 gene or locus may affect the expression level(s) of the GA20 oxidase_5 and/or endogenous GA20 oxidase_3 gene(s) through different mechanisms, such as nonsense mediated decay, non-stop decay, no-go decay, DNA or histone methylation or other epigenetic changes, inhibition or decreased efficiency of transcription and/or translation, ribosomal interference, interference with mRNA processing or splicing, and/or ubiquitin-mediated protein degradation via the proteasome. See, e.g., Nickless, A. et al., "Control of gene expression through the nonsense-mediated RNA decay pathway", Cell Biosci 7:26 (2017); Karamyshev, A. et al., "Lost in Translation: Ribosome-Associated mRNA and Protein Quality Controls", *Frontiers in Genetics* 9:431 (2018); Inada, T., "Quality controls induced by aberrant translation", *Nucleic Acids Res* 48:3 (2020); and Szadeczky-Kardoss, I. et al., "The nonstop decay and the RNA silencing systems operate cooperatively in plants", *Nucleic Acids Res* 46:9 (2018), the entire contents and disclosures of which are incorporated herein by reference. Each of these different mechanisms may act alternatively or in addition to RNA interference (RNAi), transcriptional gene silencing (PGS) and/or post transcriptional gene silencing (PTGS) mechanisms. See, e.g., Wilson, R. C. et al., "Molecular Mechanisms of RNA Interference", *Annu Rev Biophysics* 42:217-39 (2013); and Guo, Q. et al., "RNA Silencing in Plants: Mechanism, Technologies and Applications in Horticulture Crops", *Current Genomics* 17:476-489 (2016), the entire contents and disclosures of which is incorporated herein by reference. Some of the above mechanisms may reduce expression of the edited allele itself, while others may also reduce the expression of other copy/-ies or allele(s) of the endogenous GA20 oxidase_5 and/or GA20 oxidase_3 locus/loci or gene(s). Indeed, it is envisioned that the edited endogenous GA20 oxidase_5 locus, gene or allele may not only reduce or eliminate its own expression and/or activity level, but may also have a dominant or semi-dominant effect(s) on the other copy/-ies or allele(s) of the endogenous GA20 oxidase_5 and/or GA20 oxidase_3 locus/loci or gene(s). Such dominant or semi-dominant effect(s) on the GA20 oxidase_5 and/or GA20 oxidase_3 gene(s) may operate through non-canonical suppression mechanisms that do not involve RNAi and/or formation of targeted small RNAs at a significant or detectable level.

As used herein, an "intergenic region" or "intergenic sequence" refers to a genomic region or a polynucleotide sequence located in between transcribed regions of two neighboring genes. For example, the endogenous Zm.GA20ox5 gene and its neighboring gene in the corn or maize genome, the s-adenosyl methyl transferase (SAMT) or Zm.SAMT gene, contains an intergenic region between the 3' UTR of the Zm.GA20ox5 gene and the 3' UTR of the Zm.SAMT gene.

In the corn genome, the Zm.GA20ox5 gene located next to the Zm.SAMT gene. These two genes are separated by an intergenic region of about 550 bp, with the Zm.SAMT gene positioned downstream and oriented in the opposite orientation relative to the Zm.GA20ox5 gene. A reference genomic sequence of the region encompassing the Zm.GA20ox5 and Zm.SAMT genes is provided in SEQ ID NOs. 226 and 227. SEQ ID NO. 226 represents the sequence of the sense strand of the Zm.GA20ox5 gene encompassing both Zm.GA20ox5 and Zm.SAMT genes. SEQ ID NO: 226 partially overlaps with SEQ ID NO: 222 and has a shorter Zm.GA20ox5 upstream sequence and a longer Zm.GA20ox5 downstream sequence compared to the SEQ ID NO: 222. SEQ ID NO. 227 represents the sequence of the sense strand of the Zm.SAMT gene (i.e., the antisense strand of the Zm.GA20ox5 gene) encompassing both Zm.GA20ox5 and Zm.SAMT genes.

In an aspect, a mutant allele of the endogenous GA20 oxidase_5 locus, wherein the mutant allele comprises a genome modification comprising a deletion of at least a portion of the transcription termination sequence of the endogenous Zm.SAMT gene, and wherein the mutant allele produces a RNA molecule comprising an antisense sequence complementary to all or part of the sense strand of the endogenous GA20 oxidase_5 gene.

In an aspect, a mutant allele of the endogenous GA20 oxidase_5 locus, wherein the mutant allele comprises a genome modification comprising a deletion of at least a portion of the intergenic region between the endogenous GA20 oxidase_5 and Zm.SAMT genes, and wherein the mutant allele produces a RNA molecule comprising an antisense sequence complementary to all or part of the sense strand of the endogenous GA20 oxidase_5 gene.

In an aspect, a mutant allele of the endogenous GA20 oxidase_5 locus, wherein the mutant allele comprises a genome modification comprising a deletion of at least a portion of one or more of the following: 5' UTR, $1^{st}$ exon, $1^{st}$ intron, $2^{nd}$ exon, $2^{nd}$ intron, $3^{rd}$ exon, 3' UTR, and any portion thereof, and the 5' UTR, $1^{st}$ exon, $1^{st}$ intron, $2^{nd}$ exon, $2^{nd}$ intron, $3^{rd}$ exon, $3^{rd}$ intron, $4^{th}$ exon, $4^{th}$ intron, $5^{th}$ exon, $5^{th}$ intron, $6^{th}$ exon, $6^{th}$ intron, $7^{th}$ exon, $7^{th}$ intron, $8^{th}$ exon, 3' UTR, and any portion thereof, of the endogenous Zm.SAMT gene.

In an aspect, a mutant allele comprises a genome modification which results in the transcription of an antisense strand of at least an exon, an intron, or an untranslated region (UTR) of an endogenous GA20 oxidase_5 gene, or any portion thereof.

In an aspect, a mutant allele comprises the Zm.SAMT gene promoter, or a functional part thereof, operably linked to at least one transcribable antisense sequence of at least an exon, intron or untranslated region (UTR) of the endogenous GA20 oxidase_5 gene, or any portion thereof.

In an aspect, a mutant allele comprises a sequence selected from the group consisting of SEQ ID NOs: 304-322.

In an aspect, a mutant allele comprises a first sequence and a second sequence; wherein the first sequence comprises one or more of the 5' UTR, $1^{st}$ exon, $1^{st}$ intron, $2^{nd}$ exon, $2^{nd}$ intron, $3^{rd}$ exon, 3' UTR, and any complementary sequence thereof, and any portion of the foregoing, of the endogenous Zm.GA20 oxidase_5 gene; and wherein the second sequence comprises one or more of the 5' UTR, $1^{st}$ exon, $1^{st}$ intron, $2^{nd}$ exon, $2^{nd}$ intron, $3^{rd}$ exon, $3^{rd}$ intron, $4^{th}$ exon, $4^{th}$ intron, $5^{th}$ exon, $5^{th}$ intron, $6^{th}$ exon, $6^{th}$ intron, $7^{th}$ exon, $7^{th}$ intron, $8^{th}$ exon, 3' UTR, and any complementary sequence thereof, and any portion of the foregoing, of the endogenous Zm.SAMT gene; wherein the first sequence and the second sequence are contiguous or separated only by an intervening sequence of fewer than 555 nucleotides. In an aspect, a mutant allele comprises a genomic deletion relative to a wild type allele of the endogenous GA20 oxidase_5 locus, wherein the genomic deletion is flanked by a first sequence and a second sequence; wherein the first sequence comprises one or more of the 5' UTR, 1$^{st}$ exon, 1$^{st}$ intron, 2$^{nd}$ exon, 2$^{nd}$ intron, 3$^{rd}$ exon, 3' UTR, and any complementary sequence thereof, and any portion of the foregoing, of the endogenous Zm.GA20 oxidase_5 gene; and wherein the second sequence comprises one or more of the 5' UTR, 1$^{st}$ exon, 1$^{st}$ intron, 2$^{nd}$ exon, 2$^{nd}$ intron, 3$^{rd}$ exon, 3$^{rd}$ intron, 4$^{th}$ exon, 4$^{th}$ intron, 5$^{th}$ exon, 5$^{th}$ intron, 6$^{th}$ exon, 6$^{th}$ intron, 7$^{th}$ exon, 7$^{th}$ intron, 8$^{th}$ exon, 3' UTR, and any complementary sequence thereof, and any portion of the foregoing, of the endogenous Zm.SAMT gene. In an aspect, a mutant allele comprises a genomic sequence comprising a first sequence and a second sequence; wherein the first sequence comprises at least 15, at least 20, at least 25, at least 30, at least 35, at least 40, at least 45, at least 50, at least 100, at least 200, at least 300, at least 400, at least 500, at least 750, or at least 1000 consecutive nucleotides of one or more of SEQ ID NOs: 228-235 and 276-283; wherein the second sequence comprises at least 15, at least 20, at least 25, at least 30, at least 35, at least 40, at least 45, at least 50, at least 100, at least 200, at least 300, at least 400, at least 500, at least 750, or at least 1000 consecutive nucleotides of one or more of SEQ ID NOs: 235-276; and wherein the genomic sequence is at least 50, at least 100, at least 250, at least 500, or at least 1000 consecutive nucleotides in length, and/or fewer than 9000 consecutive nucleotides in length. In an aspect, a first sequence comprises one or more of SEQ ID NOs: 228-235 and 276-283, or any portion thereof, and a second sequence comprises one or more of SEQ ID NOs: 235-276, or any portion thereof. In an aspect, a first sequence comprises one or more of SEQ ID NOs: 226-235 and 276-283, or any portion thereof, and a second sequence comprises one or more of SEQ ID NOs: 226, 227, and 235-276, or any portion thereof. In an aspect, a first sequence comprises at least 15, at least 20, at least 25, at least 30, at least 35, at least 40, at least 45, at least 50, at least 100, at least 200, at least 300, at least 400, at least 500, at least 750, or at least 1000 consecutive nucleotides of one or more of SEQ ID NOs: 226-235 and 276-283, and a second sequence comprises at least 15, at least 20, at least 25, at least 30, at least 35, at least 40, at least 45, at least 50, at least 100, at least 200, at least 300, at least 400, at least 500, at least 750, or at least 1000 consecutive nucleotides of one or more of SEQ ID NOs: 226, 227, and 235-276.

In an aspect, a genome modification further comprises the deletion of at least a portion of the transcription termination sequence of an endogenous GA20 oxidase_5 gene. In an aspect, a genome modification comprises a deletion of one or both of the transcription termination sequences of an endogenous GA20 oxidase_5 gene and an endogenous Zm.SAMT gene. In an aspect, a genome modification comprises a deletion of at least 10, at least 15, at least 20, at least 25, at least 30, at least 35, at least 40, at least 45, at least 50, at least 100, at least 200, at least 300, at least 400, at least 500, at least 750, or at least 1000 consecutive nucleotides of the intergenic region between the endogenous GA20 oxidase_5 and SAMT genes. In an aspect, a genome modification comprises a deletion of the entire intergenic region between the endogenous GA20 oxidase_5 and SAMT genes. In an aspect, a genome modification comprises a deletion of one or more sequence elements selected from the group consisting of the 5' UTR, 1$^{st}$ exon, 1$^{st}$ intron, 2$^{nd}$ exon, 2$^{nd}$ intron, 3$^{rd}$ exon, 3' UTR, and any portion of the foregoing, of an endogenous GA20 oxidase_5 gene. In an aspect, a genome modification comprises a deletion of one or more sequence elements selected from the group consisting of the 5' UTR, 1$^{st}$ exon, 1$^{st}$ intron, 2$^{nd}$ exon, 2$^{nd}$ intron, 3$^{rd}$ exon, 3$^{rd}$ intron, 4$^{th}$ exon, 4$^{th}$ intron, 5$^{th}$ exon, 5$^{th}$ intron, 6$^{th}$ exon, 6$^{th}$ intron, 7$^{th}$ exon, 7$^{th}$ intron, 8' exon, 3' UTR, and any portion of the foregoing, of the endogenous Zm.SAMT locus. In an aspect, a genome modification results in the production of an RNA molecule comprising an antisense sequence from a genomic segment of selected from the group consisting of an exon, a portion of an exon, an intron, a portion of an intron, a 5' or 3' untranslated region (UTR), a portion of an UTR, and any combination of the foregoing, of the endogenous GA20 oxidase_5 locus. In an aspect, a genome modification comprises two or more, three or more, four or more, five or more, or six or more non-contiguous deletions.

In an aspect, a genomic deletion comprises a deletion of the intergenic region between the endogenous Zm.GA20 oxidase_5 and Zm.SAMT genes. In an aspect, a genomic deletion has a length of at least 50, at least 100, at least 250, at least 500, at least 750, at least 1000, at least 2500, or at least 5000 nucleotides. In an aspect, a genomic deletion has a length of at most 7500, at most 7000, at most 6000, at most 5000, at most 4000, at most 3000, at most 2500, at most 2000, at most 1000, or at most 500 nucleotides. In an aspect, a genomic deletion corresponds to a deletion of one or more genomic regions comprising a sequence selected from the group consisting of SEQ ID NOs: 228-283. In an aspect a genome deletion results in the production of an RNA transcript comprising an antisense sequence from a genomic segment of the endogenous GA20 oxidase_5 locus selected from the group consisting of an exon, portion of an exon, an intron, portion of an intron, an untranslated region (UTR), portion of an UTR, and any combination of the foregoing.

In an aspect, a mutant allele comprises the endogenous Zm.SAMT gene promoter, or a portion thereof, operably linked to a transcribable DNA sequence encoding a RNA molecule that causes suppression of one or both of the endogenous GA20 oxidase_3 gene and the endogenous GA20 oxidase_5 gene. In an aspect, a mutant allele comprises the endogenous Zm.SAMT gene promoter, or a portion thereof, operably linked to a transcribable DNA sequence encoding a RNA molecule comprising an antisense sequence that is at least 80%, at least 85%, at least 90%, at least 91%, at least 92%, at least 93%, at least 94%, at least 95%, at least 96%, at least 97%, at least 98%, at least 99%, or 100% complementary to all or part of the endogenous GA20 oxidase_3 or GA20 oxidase_5 gene. In an aspect, a transcribable DNA sequence is at least 80%, at least 85%, at least 90%, at least 91%, at least 92%, at least 93%, at least 94%, at least 95%, at least 96%, at least 97%, at least 98%, at least 99%, or 100% complementary to an RNA transcript sequence, or a portion thereof, encoded by an endogenous GA20 oxidase_3 or GA20 oxidase_5 gene. In an aspect, a transcribable DNA sequence is at least 80% complementary to at least 15, at least 16, at least 17, at least 18, at least 19, at least 20, at least 21, at least 22, at least 23, at least 24, at least 25, at least 26, at least 27, at least 28, at least 29, at least 30, at least 40, at least 50, at least 60, at least 70, at least 80, at least 90, at least 100, or at least 200 consecutive nucleotides of one or more of SEQ ID NOs: 218-220, 222-224, 226, and 228-255. In an aspect, a transcribable DNA sequence is at least 80% complementary to at least 15, at least 16, at least 17, at least 18, at least 19, at least 20, at least 21, at least 22, at least 23, at least 24, at least 25, at least 26, at least 27, at least 28, at least 29, at least 30, at least 40, at least 50, at least 60, at least 70, at least 80, at least 90, at least 100, or at least 200 consecutive nucleotides of one or more of SEQ ID NOs: 222-224 and 228-235.

In an aspect, a DNA segment comprises a nucleotide sequence originating from the endogenous GA20 oxidase_3 locus. In an aspect, a DNA segment corresponds to an inverted genomic fragment of the endogenous GA20 oxidase_3 locus. In an aspect, a DNA segment comprises a nucleotide sequence originating from an endogenous GA20 oxidase_5 locus. In an aspect, a DNA segment is inserted near or adjacent to a corresponding endogenous DNA segment of the endogenous GA20 oxidase_3 locus. In an aspect, the sense strand of a DNA segment comprises a sequence at least 70%, at least 80%, at least 90%, at least 91%, at least 92%, at least 93%, at least 94%, at least 95%, at least 96%, at least 97%, at least 98%, at least 99%, or 100% complementary to an exon sequence of the endogenous GA20 oxidase_3 or GA20 oxidase_5 locus. In an aspect, the sense strand of a DNA segment comprises a sequence at least 70%, at least 80%, at least 90%, at least 91%, at least 92%, at least 93%, at least 94%, at least 95%, at least 96%, at least 97%, at least 98%, at least 99%, or 100% complementary to an untranslated region (UTR) sequence of the endogenous GA20 oxidase_3 or GA20 oxidase_5 locus. In an aspect, the sense strand of a DNA segment comprises a sequence at least 70%, at least 80%, at least 90%, at least 91%, at least 92%, at least 93%, at least 94%, at least 95%, at least 96%, at least 97%, at least 98%, at least 99%, or 100% complementary to an exon sequence and an intron sequence of the endogenous GA20 oxidase_3 or GA20 oxidase_5 locus, the exon sequence and the intron sequence being contiguous within the endogenous locus. In an aspect, a DNA segment comprises a sequence having at least at least 70%, at least 80%, at least 90%, at least 91%, at least 92%, at least 93%, at least 94%, at least 95%, at least 96%, at least 97%, at least 98%, at least 99%, or 100% identity to one or more of SEQ ID NOs: 194, 195, 207, 209, 211, 213, and 217.

In an aspect, a corresponding endogenous sequence of an RNA transcript is at least 85%, at least 90%, at least 91%, at least 92%, at least 93%, at least 94%, at least 95%, at least 96%, at least 97%, at least 98%, at least 99%, or 100% identical to at least 20, at least 30, at least 40, at least 50, at least 100, at least 200, at least 300, at least 400, at least 500, at least 600, at least 700, at least 800, at least 900, or at least 1000 consecutive nucleotides of one or more of SEQ ID NOs: 182-184 and 186-188. In an aspect, an antisense RNA sequence forms a stem-loop structure with the corresponding endogenous sequence of the RNA transcript. In an aspect, an RNA transcript further comprises one or more sequence elements of the endogenous GA20 oxidase_5 locus selected from the group consisting of 5' UTR, 1$^{st}$ exon, 1$^{st}$ intron, 2$^{nd}$ exon, 2$^{nd}$ intron, 3$^{rd}$ exon, 3' UTR, and any portion thereof.

In an aspect, an RNA transcript sequence comprises a sequence that is at least 85%, at least 90%, at least 91%, at least 92%, at least 93%, at least 94%, at least 95%, at least 96%, at least 97%, at least 98%, at least 99%, or 100% identical to at least 20, at least 30, at least 40, at least 50, at least 100, at least 200, at least 300, at least 400, at least 500, at least 600, at least 700, at least 800, at least 900, or at least 1000 consecutive nucleotides of one or more of SEQ ID NOs: 218-220, 222-224, 226, and 228-255. In an aspect, an RNA transcript sequence comprises a sequence that is at least 85%, at least 90%, at least 91%, at least 92%, at least 93%, at least 94%, at least 95%, at least 96%, at least 97%, at least 98%, at least 99%, or 100% identical to at least 20, at least 30, at least 40, at least 50, at least 100, at least 200, at least 300, at least 400, at least 500, at least 600, at least 700, at least 800, at least 900, or at least 1000 consecutive nucleotides of one or more of SEQ ID NOs: 222-224 and 228-235.

In an aspect, an inserted DNA segment is located upstream (e.g. on the 5' side) of a corresponding endogenous DNA segment. In an aspect, an inserted DNA segment is located downstream (e.g. on the 3' side) of a corresponding endogenous DNA segment. In an aspect, a DNA segment comprises a length of at least 10, at least 15, at least 20, at least 25, at least 30, at least 40, at least 50, at least 75, at least 100, at least 200, at least 300, at least 400, at least 500, at least 600, at least 700, at least 800, or at least 900 nucleotides. In an aspect, a DNA segment comprises a length of at most 2000, at most 1500, at most 1000, at most 900, at most 800, at most 700, at most 600, at most 500, at most 400, at most 300, at most 200, at most 100, at most 75, at most 50, or at most 25 nucleotides.

In an aspect, an inserted DNA segment and the corresponding endogenous DNA segment of a mutant allele are separated by an intervening DNA sequence. In an aspect, an intervening DNA sequence comprises a length of at least 1 nucleotide. In an aspect, an intervening DNA sequence comprises a length of at least 2, at least 3, at least 4, at least 5, at least 10, at least 20, at least 30, at least 40, at least 50, at least 75, at least 100, at least 200, at least 300, at least 400, at least 500, at least 600, at least 700, at least 800, at least 900, at least 1000, at least 1500, at least 2000, at least 2500, at least 3000, or at least 40000 consecutive nucleotides. In an aspect, an intervening DNA sequence comprises at most 5000, at most 4000, at most 3000, at most 2000, at most 1500, at most 1000, at most 750, at most 500, at most 250, at most 100, at most 75, at most 50, at most 25, at most 10, or at most 5 consecutive nucleotides.

In an aspect, an intervening DNA sequence encodes an intervening RNA sequence between an antisense RNA sequence and a corresponding endogenous sequence of an RNA transcript. In an aspect, an RNA transcript forms a stem-loop structure with an intervening RNA sequence forming the loop portion of the stem-loop structure. In an aspect, a stem-loop secondary structure comprises a near-perfect-complement stem with mismatches. In an aspect, a near-perfect-complement stem comprises fewer than 10, fewer than 9, fewer than 8, fewer than 7, fewer than 6, fewer than 5, fewer than 4, fewer than 3, or fewer than 2 mismatches. In an aspect, a stem-loop secondary structure comprises a perfect complement stem with zero mismatches. In an aspect, an intervening DNA sequence comprises an intron sequence. In an aspect, an intervening DNA sequence does not comprise an intron sequence.

In an aspect, an intervening DNA sequence comprises a native sequence of the endogenous GA20 oxidase_3 locus. In an aspect, an intervening DNA sequence comprises an exogenous sequence inserted into the endogenous GA20 oxidase_3 locus. In an aspect, an intervening DNA sequence comprises a native sequence of the endogenous GA20 oxidase_5 locus. In an aspect, an intervening DNA sequence comprises an exogenous sequence inserted into the endogenous GA20 oxidase_5 locus. In an aspect, a DNA segment is inserted within a region selected from the group consisting of 5' untranslated region (UTR), 1$^{st}$ exon, 1$^{st}$ intron, 2$^{nd}$ exon, 2$^{nd}$ intron, 3$^{rd}$ exon and 3' UTR of the endogenous GA20 oxidase_3 locus, and a combination thereof. In an aspect a DNA segment is inserted at a genomic site recognized by a targeted editing technique to create a double-stranded break (DSB). In an aspect, a DNA segment comprises a nucleotide sequence originating from an endogenous GA20 oxidase_3 locus. In an aspect, a DNA segment corresponds to an inverted genomic fragment of the endogenous GA20 oxidase_3 locus. In an aspect, a DNA segment comprises a nucleotide sequence originating from the endogenous GA20 oxidase_5 locus. In an aspect, a DNA segment corresponds to an inverted genomic fragment of the endogenous GA20 oxidase_5 locus. In an aspect, a DNA segment is inserted near or adjacent to a corresponding endogenous DNA segment of the endogenous GA20 oxidase_5 locus.

In an aspect, this disclosure provides a corn plant where the level of one or more active GAs in at least one internode tissue of the stem or stalk of the modified corn plant is lower than the same internode tissue of an unmodified control plant.

Any method known in the art for suppression of a target gene can be used to suppress GA oxidase or brachytic gene(s) according to aspects of the present disclosure including expression of antisense RNAs, double stranded RNAs (dsRNAs) or inverted repeat RNA sequences, or via co-suppression or RNA interference (RNAi) through expression of small interfering RNAs (siRNAs), short hairpin RNAs (shRNAs), trans-acting siRNAs (ta-siRNAs), or micro RNAs (miRNAs). Collectively, antisense RNAs, dsRNAs, inverted repeat RNA sequences, siRNAs, shRNAs, ta-siRNAs, and miRNAs are referred to herein as "non-coding RNAs." Furthermore, sense and/or antisense RNA molecules can be used that target the non-coding genomic sequences or regions within or near a gene to cause silencing of the gene. Accordingly, any of these methods can be used for the targeted suppression of an endogenous GA oxidase gene(s) or br2 in a tissue-specific or tissue-preferred manner. See, e.g., U.S. Patent Application Publication Nos. 2009/0070898, 2011/0296555, and 2011/0035839, the contents and disclosures of which are incorporated herein by reference.

In an aspect, an RNA molecule is an antisense RNA.

In an aspect, at least a portion of an antisense RNA sequence is at least 70%, at least 80%, at least 90%, at least 91%, at least 92%, at least 93%, at least 94%, at least 95%, at least 96%, at least 97%, at least 98%, at least 99%, or 100% complementary to a corresponding endogenous sequence of an RNA transcript. In an aspect, an antisense RNA sequence hybridizes to a corresponding endogenous sequence of an RNA transcript. In an aspect, an antisense RNA sequence encoded by an inserted DNA segment hybridizes to a corresponding endogenous sequence of an RNA transcript encoded by a corresponding endogenous DNA segment. In an aspect, an antisense RNA sequence forms a stem-loop structure with a corresponding endogenous sequence of an RNA transcript.

In an aspect, a mutant allele produces a RNA molecule comprising an antisense sequence that is at least 80%, at least 85%, at least 90%, at least 91%, at least 92%, at least 93%, at least 94%, at least 95%, at least 96%, at least 97%, at least 98%, at least 99%, or 100% complementary to a RNA transcript sequence, or a portion thereof, encoded by the endogenous GA20 oxidase_5 gene. In an aspect, an antisense sequence of an RNA molecule is at least 80%, at least 85%, at least 90%, at least 91%, at least 92%, at least 93%, at least 94%, at least 95%, at least 96%, at least 97%, at least 98%, at least 99%, or 100% complementary to at least 15, at least 16, at least 17, at least 18, at least 19, at least 20, at least 21, at least 22, at least 23, at least 24, at least 25, at least 26, at least 27, at least 28, at least 29, at least 30, at least 40, at least 50, at least 75, at least 100, or at least 200 consecutive nucleotides of one or more of SEQ ID NOs: 218-220, 222-224, 226, and 228-255. In an aspect, an antisense sequence of an RNA molecule is at least 80%, at least 85%, at least 90%, at least 91%, at least 92%, at least 93%, at least 94%, at least 95%, at least 96%, at least 97%, at least 98%, at least 99%, or 100% complementary to at least 15, at least 16, at least 17, at least 18, at least 19, at least 20, at least 21, at least 22, at least 23, at least 24, at least 25, at least 26, at least 27, at least 28, at least 29, at least 30, at least 40, at least 50, at least 75, at least 100, or at least 200 consecutive nucleotides of one or more of SEQ ID NOs: 222-224 and 228-235.

In an aspect, an antisense sequence can hybridize with an RNA transcript encoded by a wild-type allele of one or both of the endogenous GA20 oxidase_3 gene and the endogenous GA20 oxidase_5 gene. In an aspect, an antisense sequence can hybridize with a sense RNA transcript encoded by an endogenous GA20 oxidase_5 gene. In an aspect, an antisense sequence can hybridize with a sense RNA transcript encoded by the mutant allele of the endogenous GA20 oxidase_5 gene. In an aspect, hybridization between an antisense RNA and a sense RNA can cause suppression of a wild-type or mutant allele of the endogenous GA20 oxidase_3 gene, a wild-type or mutant allele of the endogenous GA20 oxidase_5 gene, or a wild-type or mutant allele of both genes.

In an aspect, a sense RNA transcript encoded by the mutant allele of the endogenous GA20 oxidase_5 gene is shortened or truncated relative to a wild-type allele of the endogenous GA20 oxidase_5 gene.

In an aspect, a mutant allele can suppress the expression of a wild-type allele of the endogenous GA20 oxidase_3 locus, a wild-type allele of the endogenous GA20 oxidase_5 locus, or both.

In an aspect, an expression level(s) of one or more endogenous GA20 oxidase and/or GA3 oxidase gene(s) is/are reduced or eliminated in the corn plant, thereby suppressing the endogenous GA20 oxidase and/or GA3 oxidase gene(s).

According to an aspect, a corn plant is provided having the expression level(s) of one or more GA20 oxidase gene(s) reduced in at least one plant tissue by at least 5%, at least 10%, at least 20%, at least 25%, at least 30%, at least 40%, at least 50%, at least 60%, at least 70%, at least 75%, at least 80%, at least 90%, or 100%, as compared to a control corn plant.

According to an aspect, a corn plant is provided having the expression level(s) of one or more GA3 oxidase gene(s) reduced in at least one plant tissue by at least 5%, at least 10%, at least 20%, at least 25%, at least 30%, at least 40%, at least 50%, at least 60%, at least 70%, at least 75%, at least 80%, at least 90%, or 100%, as compared to a control corn plant.

According to an aspect, a corn plant is provided having the expression level(s) of one or more GA20 oxidase gene(s) reduced in at least one plant tissue by 5%-20%, 5%-25%, 5%-30%, 5%-40%, 5%-50%, 5%-60%, 5%-70%, 5%-75%, 5%-80%, 5%-90%, 5%-100%, 75%-100%, 50%-100%, 50%-90%, 50%-75%, 25%-75%, 30%-80%, or 10%-75%, as compared to a control corn plant.

According to an aspect, a corn plant is provided having the expression level(s) of one or more GA3 oxidase gene(s) reduced in at least one plant tissue by 5%-20%, 5%-25%, 5%-30%, 5%-40%, 5%-50%, 5%-60%, 5%-70%, 5%-75%, 5%-80%, 5%-90%, 5%-100%, 75%-100%, 50%-100%, 50%-90%, 50%-75%, 25%-75%, 30%-80%, or 10%-75%, as compared to a control corn plant.

According to an aspect, the at least one tissue of a corn plant having a reduced expression level of a GA20 oxidase and/or GA3 oxidase gene(s) includes one or more active GA producing tissue(s) of the plant, such as the vascular and/or leaf tissue(s) of the plant, during one or more vegetative stage(s) of development.

In an aspect, suppression of an endogenous GA20 oxidase gene or a GA3 oxidase gene is tissue-specific (e.g., only in leaf and/or vascular tissue). Suppression of a GA20 oxidase gene can be constitutive and/or vascular or leaf tissue specific or preferred. In other aspects, suppression of a GA20 oxidase gene or a GA3 oxidase gene is constitutive and not tissue-specific. According to an aspect, expression of an endogenous GA20 oxidase gene and/or a GA3 oxidase gene is reduced in one or more tissue types (e.g., in leaf and/or vascular tissue(s)) of a modified or transgenic plant as compared to the same tissue(s) of a control plant.

Certain mutations of brachytic genes have been shown to result in a short stature, semi-dwarf phenotype. In an aspect of the present disclosure, a female corn plant is provided having a non-silent mutation or edit in a brachytic gene. See, e.g., PCT Application No. PCT/US2016/029492 and PCT/US2017/067888, the entire contents and disclosures of which are incorporated herein by reference. Thus, a shorter female corn plant can comprise a mutation (or edit) in a brachytic gene, and can be homozygous (or biallelic) for a mutation (or edit) in a brachytic gene. As used herein, a "brachytic mutant plant" refers to a plant having a short semi-dwarf height and stature relative to a control plant (e.g., a wild-type sibling plant comprising all other traits except the brachytic trait) due to a shortening of the average internode length. Such a brachytic mutant plant can have a short semi-dwarf height and stature due to a shortening of the average internode length. As used herein, a "brachytic gene", "BR gene" or "br gene", or "Br gene" refers to any brachytic gene in a corn plant that when mutated or edited to reduce its expression or function can result in a shorter, semi-dwarf corn plant and phenotype. In an aspect, a female inbred corn plant or plurality of female inbred corn plants provided herein each has a non-silent mutation or edit in a brachytic gene. In an aspect, the brachytic gene is a br1 mutant gene. In another aspect, the brachytic gene is a br2 mutant gene. In yet another aspect, the brachytic gene is a br3 mutant gene.

In maize, brachytic mutants have a short stature due to a shortening of the internode length without a corresponding reduction in the number of internodes or the number and size of other organs, including the leaves, ear and tassel. See Kempton *J. Hered.* 11:111-115(1920); Pilu et al., *Molecular Breeding,* 20:83-91(2007). Three brachytic mutants have been isolated in maize to date: brachytic1 (br1), brachytic2 (br2) and brachytic3 (br3). Br3 is also commonly referred to as brevis plant 1 (bv1). Both br1 and br3 mutations cause a reduction in corn plant height, which has been thought too severe for commercial exploitation due to potential impacts on yield. In contrast, the br2 mutant has particular agronomic potential because of shortening of the internodes of the lower stalk without an obvious reduction in other plant organs. In addition, br2 lines exhibit an unusual stalk strength and tolerance to wind lodging, while the leaves are often darker and persist longer in the active green than those of the wild-type plants. The br2 phenotype is insensitive to treatment with gibberellins, auxins, brassinosteroids and cytokinins, suggesting that the biosynthesis of these hormones is not modified by the br2 mutation. Multani et al. identified the genomic sequence of the br2 gene (SEQ ID NO: 58) and deposited it under GenBank Accession No. AY366085. See Multani et al., *Science,* 302(5642)81-84 (2003). br2 was annotated to encode a putative protein similar to adenosine triphosphate (ATP)-binding cassette transporters of the multidrug resistant (MDR) class of P-glycoproteins (PGPs). Pilu et al. reported a br2-23 allele having an 8-bp deletion in the 3' end of the br2 gene and claimed a direct relationship between this deletion and the brachytic phenotype in their br2-23 plants. See Pilu et al., *Molecular Breeding,* 20:83-91(2007). Nevertheless, the use of brachytic mutations in corn has not been exploited commercially partly because of the severity of the available brachytic mutant alleles.

A wild-type genomic DNA sequence of the br2 locus from a reference genome is provided in SEQ ID NO: 132. A wild-type cDNA sequence of the br2 locus from a reference genome is provided in SEQ ID NO: 180. A wild-type amino acid sequence encoded by SEQ ID NO: 180 is provided in SEQ ID NO: 181.

For the br2 gene, SEQ ID NO: 132 provides 954 nucleotides upstream of the br2 5'-UTR; nucleotides 955-1000 correspond to the 5'-UTR; nucleotides 1001-1604 correspond to the first exon; nucleotides 1605-1747 correspond to the first intron; nucleotides 1748-2384 correspond to the second exon; nucleotides 2385-2473 correspond to the second intron; nucleotides 2474-2784 correspond to the third exon; nucleotides 2785-3410 correspond to the third intron; nucleotides 3411-3640 correspond to the fourth exon; nucleotides 3641-5309 correspond to the fourth intron; nucleotides 5310-7667 correspond to the fifth exon; and nucleotides 7668-8029 correspond to the 3'-UTR. SEQ ID NO: 132 also provides 638 nucleotides downstream of the end of the 3'-UTR (nucleotides 8030-8667).

As used herein, a "brachytic allele" is an allele at a particular genomic locus that confers, or contributes to, a brachytic or semi-dwarf phenotype, such as an allele of a brachytic gene that causes a brachytic or semi-dwarf phenotype, or alternatively, is an allele that allows for the identification of plants that comprise a brachytic phenotype or plants that can give rise to progenies with a brachytic phenotype. For example, a brachytic allele of a marker can be a marker allele that segregates with a brachytic phenotype.

In some aspects, a brachytic, dwarf, or semi-dwarf corn plant comprises a reduced level of br2 mRNA and/or protein, as compared to a control corn plant not having the brachytic allele. In other aspects, the corn plants or seeds comprise reduced Br2 protein activity compared to a control plant not having the brachytic allele. In some aspects, the height of a brachytic, dwarf, or semi-dwarf plant comprising a brachytic allele at maturity is reduced by at least 10%, at least 20%, at least 30%, at least 40%, at least 50%, at least 60%, or at least 70% compared to a control plant not having a brachytic allele. In another aspect, the yield of a brachytic, dwarf, or semi-dwarf corn plant comprising a brachytic allele is equal to or more than the yield of a control plant not having the brachytic allele. In an aspect, a brachytic, dwarf, or semi-dwarf corn plant comprising a brachytic allele requires about 5%, 10%, 15%, 20%, or 25% fewer heat units than a control plant not having the brachytic allele to reach anthesis. In an aspect, a brachytic, dwarf, or semi-dwarf corn plant is homozygous for a brachytic allele. In another aspect, a brachytic, dwarf, or semi-dwarf corn plant is heterozygous for a brachytic allele. In another aspect, a brachytic, dwarf, or semi-dwarf corn plant is a hybrid. In another aspect, a brachytic, dwarf, or semi-dwarf corn plant is an inbred, such as a female inbred.

In an aspect, this disclosure provides brachytic, dwarf, or semi-dwarf corn plants comprising a brachytic allele comprising one or more sequences selected from the group consisting of SEQ ID NOs: 59-85. In another aspect, a brachytic, dwarf, or semi-dwarf corn plant comprises a single gene conversion of the br2 genomic region.

In an aspect, a brachytic, dwarf, or semi-dwarf corn plant comprises a brachytic allele at a polymorphic locus, wherein the polymorphic locus is associated with, or linked to, a marker selected from the group consisting of SEQ ID NOs: 86-131. In another aspect, a brachytic allele at a polymorphic locus is within 20 cM (centimorgans), within 10 cM, within 5 cM, within 1 cM, or within 0.5 cM of a marker selected from the group consisting of SEQ ID NOs: 86-131. In another aspect, a brachytic allele is at a polymorphic locus within 20 cM, within 10 cM, within 5 cM, within 1 cM, or within 0.5 cM of a marker selected from the group consisting of SEQ ID NOs: 90-117. In another aspect, a brachytic allele is at a polymorphic locus within 20 cM, within 10 cM, within 5 cM, within 1 cM, or within 0.5 cM of a marker selected from the group consisting of SEQ ID NOs: 92 and 117.

In an aspect, a corn plant or plurality of corn plants provided herein, such as a female corn plant or inbred or a plurality or population of female corn plants, can comprise at least one non-natural brachytic mutation, where the corn plant exhibits a semi-dwarf phenotype compared to a control corn plant not comprising the at least one non-natural brachytic mutation when grown under comparable conditions. In another aspect, a corn plant provided herein can comprise at least one non-natural brachytic mutation. In another aspect, a corn plant provided herein can comprise at least one non-natural brachytic mutant allele. In another aspect, a corn plant provided herein can comprise at least one non-natural brachytic mutation and exhibits a semi-dwarf phenotype. In another aspect, a corn plant provided herein can comprise at least one non-natural brachytic mutant allele and exhibit a semi-dwarf phenotype. In another aspect, a corn plant provided herein can comprise a non-naturally occurring mutation in a br gene reducing the activity of the br gene, where the mutation is not introduced via a transposon. In another aspect, a corn plant provided herein can comprise a mutation in a br2 locus or gene as compared to a wildtype br2 locus or gene. In an aspect, a corn plant provided herein is homozygous (or biallelic) for a mutation in a br2 locus or gene as compared to a wildtype br2 locus or gene. In another aspect, a corn plant provided herein is heterozygous for a mutation in a br2 locus or gene as compared to a wildtype br2 locus or gene. In another aspect, a corn plant provided herein can comprise a modified br2 gene with reduced activity, where the corn plant does not comprise a br2-23 brachytic allele or SNP5259. In another aspect, a corn plant provided herein can comprise a synthetic mutation in a br gene, reducing the activity of the br gene.

In an aspect, a corn plant or plurality of corn plants provided herein, such as a female corn plant or inbred or a plurality or population of female corn plants, can each comprise a non-transgene or non-transposon mediated mutation in a br gene reducing the activity of the br gene. In another aspect, a corn plant provided herein can comprise a recessive, non-transgenic br mutant allele. In another aspect, a corn plant provided herein can comprise a heterologous polynucleotide capable of suppressing expression of a br gene or an mRNA transcribed therefrom. In another aspect, a corn plant provided herein can comprise a heterologous polynucleotide capable of suppressing expression of a br1 gene or an mRNA transcribed therefrom. In another aspect, a corn plant provided herein can comprise a heterologous polynucleotide capable of suppressing expression of a br2 gene or an mRNA transcribed therefrom. In another aspect, a corn plant provided herein can comprise a heterologous polynucleotide capable of suppressing expression of a br3 gene or an mRNA transcribed therefrom. Additional details about altering the expression of br genes can be found in PCT Application No. PCT/US2016/029492 and PCT/US2017/067888, the entire contents and disclosure of which are incorporated herein by reference.

In an aspect, a mutant allele of an endogenous br2 locus suppresses the expression of a wild-type allele of the endogenous br2 locus. In an aspect, a mutant allele product of an endogenous br2 locus disrupts the function of a wild-type allele product of the endogenous br2 locus. In an aspect, a "product" of a mutant allele is a mRNA transcript. In an aspect, a "product" of a mutant allele comprises an antisense RNA. In an aspect, a "product" of a mutant allele is a protein.

In an aspect, this disclosure provides a mutant allele of an endogenous br2 locus, where the mutant allele comprises a DNA segment inserted into the endogenous br2 locus, wherein the DNA segment encodes an antisense RNA that is at least 70%, at least 80%, at least 90%, at least 91%, at least 92%, at least 93%, at least 94%, at least 95%, at least 96%, at least 97%, at least 98%, at least 99%, or 100% complementary to at least 20, at least 30, at least 40, at least 50, at least 100, at least 200, at least 300, at least 400, at least 500, at least 600, at least 700, at least 800, at least 900, or at least 1000 consecutive nucleotides of SEQ ID NOs: 132 or 180, and wherein the mutant allele of the endogenous br2 locus produces an RNA transcript comprising the antisense RNA sequence. In an aspect, a mutant allele of an endogenous br2 locus further comprises deletion of at least one portion of the endogenous br2 locus. In an aspect, a "portion" of an endogenous br2 locus refers to at least 1 nucleotide.

In an aspect, a modified corn plant, or plant part thereof, is homozygous for a deletion within an endogenous br2 locus. In an aspect, a modified corn plant, or plant part thereof, is biallelic for a first mutant allele and a second mutant allele each within an endogenous br2 locus. In an aspect, a first mutant allele comprises a deletion and/or an inversion or antisense sequence. In an aspect, a second mutant allele comprises a deletion and/or an inversion or antisense sequence. In an aspect, a modified corn plant, or plant part thereof, is heterozygous for a deletion and/or an inversion or antisense sequence within an endogenous br2 locus.

In an aspect, a modified corn plant, or plant part thereof, is homozygous for a mutant allele at an endogenous br2 locus. In an aspect, a modified corn plant, or plant part thereof, is biallelic for a first mutant allele and a second mutant allele at an endogenous br2 locus. In an aspect, a modified corn plant, or plant part thereof, is heterozygous for a mutant allele at an endogenous br2 locus.

In an aspect, a deletion within an endogenous br2 locus comprises between 1 nucleotide and 8667 nucleotides, between 1 nucleotide and 8000 nucleotides, between 1 nucleotide and 7000 nucleotides, between 1 nucleotide and 6000 nucleotides, between 1 nucleotide and 5000 nucleotides, between 1 nucleotide and 4000 nucleotides, between 1 nucleotide and 3000 nucleotides, between 1 nucleotide and 2000 nucleotides, between 1 nucleotide and 1000 nucleotides, between 1 nucleotide and 750 nucleotides, between 1 nucleotide and 500 nucleotides, between 1 nucleotide and 250 nucleotides, between 1 nucleotide and 100 nucleotides, between 1 nucleotide and 50 nucleotides, between 10 nucleotide and 8000 nucleotides, between 10 nucleotide and 5000 nucleotides, between 10 nucleotide and 2500 nucleotides, between 10 nucleotide and 1000 nucleotides, between 10 nucleotide and 100 nucleotides, between 100 nucleotide and 8000 nucleotides, between 100 nucleotide and 5000 nucleotides, between 100 nucleotide and 2500 nucleotides, between 100 nucleotide and 1000 nucleotides, or between 100 nucleotide and 500 nucleotides. In an aspect, a deletion within an endogenous br2 locus comprises at least 1 nucleotide. In an aspect, a deletion within an endogenous br2 locus comprises at least 2 nucleotides. In an aspect, a deletion within an endogenous br2 locus comprises at least 5 nucleotides. In an aspect, a deletion within an endogenous br2 locus comprises at least 10 nucleotides. In an aspect, a deletion within an endogenous br2 locus comprises at least 20 nucleotides. In an aspect, a deletion within an endogenous br2 locus comprises at least 30 nucleotides. In an aspect, a deletion within an endogenous br2 locus comprises at least 40 nucleotides. In an aspect, a deletion within an endogenous br2 locus comprises at least 50 nucleotides. In an aspect, a deletion within an endogenous br2 locus comprises at least 100 nucleotides. In an aspect, a deletion within an endogenous br2 locus comprises at least 200 nucleotides. In an aspect, a deletion within an endogenous br2 locus comprises at least 300 nucleotides. In an aspect, a deletion within an endogenous br2 locus comprises at least 400 nucleotides. In an aspect, a deletion within an endogenous br2 locus comprises at least 500 nucleotides.

In an aspect, this disclosure provides a mutant allele of an endogenous br2 locus, where the mutant allele comprises a deletion of at least one nucleotide from at least one exon of an endogenous br2 locus as compared to SEQ ID NO: 132. In an aspect, a deletion further comprises the deletion of at least one exon of an endogenous br2 locus as compared to SEQ ID NO: 132. In an aspect, a deletion comprises the deletion of an endogenous br2 locus. In an aspect, a deletion comprises the deletion of at least two exons from an endogenous br2 locus. In an aspect, two deleted exons from an endogenous br2 locus are contiguous. In an aspect, two deleted exons from an endogenous br2 locus are not contiguous. In an aspect, the first exon of an endogenous br2 locus is deleted. In an aspect, the second exon of an endogenous br2 locus is deleted. In an aspect, the third exon of an endogenous br2 locus is deleted. In an aspect, the fourth exon of an endogenous br2 locus is deleted. In an aspect, the fifth exon of an endogenous br2 locus is deleted. In an aspect, a deletion further comprises the deletion of at least one nucleotide from at least one intron of an endogenous br2 locus. In an aspect, a deletion further comprises the deletion of at least one nucleotide from at least one intron of an endogenous br2 locus. In an aspect, a deletion comprises the deletion of at least one intron of an endogenous br2 locus. In an aspect, a deletion comprises the deletion of at least one nucleotide of the 5'-untranslated region of the endogenous br2 locus. In an aspect, a deletion comprises the deletion of at least one nucleotide of the 3'-untranslated region of the endogenous br2 locus.

In an aspect, a deletion comprises deletion of at least one nucleotide of the first exon of an endogenous br2 locus. In an aspect, a deletion comprises deletion of at least one nucleotide of the second exon of an endogenous br2 locus. In an aspect, a deletion comprises deletion of at least one nucleotide of the third exon of an endogenous br2 locus. In an aspect, a deletion comprises deletion of at least one nucleotide of the fourth exon of an endogenous br2 locus. In an aspect, a deletion comprises deletion of at least one nucleotide of the fifth exon of an endogenous br2 locus.

In an aspect, a deletion comprises deletion of the first exon of an endogenous br2 locus. In an aspect, a deletion comprises deletion of the second exon of an endogenous br2 locus. In an aspect, a deletion comprises deletion of the third exon of an endogenous br2 locus. In an aspect, a deletion comprises deletion of the fourth exon of an endogenous br2 locus. In an aspect, a deletion comprises deletion of the fifth exon of an endogenous br2 locus.

In an aspect, a deletion comprises deletion of at least one nucleotide of at least one intron of an endogenous br2 locus. In an aspect, a deletion comprises deletion of at least one intron of an endogenous br2 locus. In an aspect, a deletion comprises deletion of at least one nucleotide of the 5'-untranslated region of an endogenous br2 locus. In an aspect, a deletion comprises deletion of the 5'-untranslated region of an endogenous br2 locus. In an aspect, a deletion comprises deletion of at least one nucleotide of the 3'-untranslated region of an endogenous br2 locus. In an aspect, a deletion comprises deletion of the 3'-untranslated region of an endogenous br2 locus.

In an aspect, a deletion comprises a deletion of at least one nucleotide of at least one intron, a deletion of at least one nucleotide of at least one exon, at least one nucleotide of a 5'-untranslated region (UTR), at least one nucleotide of a 3'-UTR, or any combination thereof of an endogenous br2 locus.

In an aspect, a deletion comprises deletion of at least one nucleotide from a first exon and at least one nucleotide from a second exon of an endogenous br2 locus. In an aspect, a deletion comprises deletion of at least one nucleotide from a first exon, at least one nucleotide from a second exon, and at least one nucleotide from a third exon of an endogenous br2 locus. In an aspect, a deletion comprises deletion of at least one nucleotide from a first exon, at least one nucleotide from a second exon, at least one nucleotide from a third exon, and at least one nucleotide from a fourth exon of an endogenous br2 locus. In an aspect, a deletion comprises deletion of at least one nucleotide from a first exon, at least one nucleotide from a second exon, at least one nucleotide from a third exon, at least one nucleotide from a fourth exon, and at least one nucleotide from a fifth exon of an endogenous br2 locus.

In an aspect, a deletion comprises a deletion of a first exon and a second exon from an endogenous br2 locus. In an aspect, a first deleted exon and a second deleted exon are contiguous. In an aspect, a first deleted exon and a second deleted exon are not contiguous. In an aspect, a deletion comprises deletion of a first exon and a second exon from an endogenous br2 locus. In an aspect, a deletion comprises deletion of a first exon, a second exon, and a third exon from an endogenous br2 locus. In an aspect, a deletion comprises deletion of a first exon, a second exon, a third exon, and a fourth exon from an endogenous br2 locus. In an aspect, a deletion comprises deletion of a first exon, a second exon, a third exon, a fourth exon, and a fifth exon from an endogenous br2 locus.

In an aspect, a deletion in an endogenous br2 locus results in a premature stop codon within an mRNA transcript encoding a Br2 protein. In an aspect, this disclosure provides a modified corn plant, or plant part thereof, comprising a premature stop codon within a nucleic acid sequence encoding a Brachytic2 protein as compared to a control corn plant or plant part thereof. In an aspect, a mutant allele encodes an mRNA transcript comprising a premature stop codon as compared to SEQ ID NO: 180.

According to some embodiments, an endogenous gene can be edited or engineered to express a truncated protein relative to a wild type protein by the introduction of a premature stop codon into the coding sequence and the encoded mRNA transcript of the endogenous gene. Without being bound by theory, a truncated Br2 protein expressed from an edited endogenous br2 gene comprising a premature stop codon may not only be non-functional or have reduced function, but also interfere with the functioning of a wild type Br2 protein to act in a dominant or semi-dominant manner. In an aspect, a premature stop codon within an mRNA transcript results in translation of a truncated protein as compared to a control mRNA transcript that lacks the premature stop codon. As used herein, a "stop codon" refers to a nucleotide triplet within an mRNA transcript that signals a termination of protein translation. A "premature stop codon" refers to a stop codon positioned earlier (e.g., on the 5'-side) than the normal stop codon position in an endogenous mRNA transcript. A stop codon is a nucleotide triplet in a mRNA that signals the termination of protein translation from the mRNA. Without being limiting, several stop codons are known in the art, including "UAG," "UAA," "UGA," "TAG," "TAA," and "TGA." In an aspect, a premature stop codon can arise from a frameshift mutation. Frameshift mutations can be caused by the insertion or deletion of one or more nucleotides in a protein-coding sequence. In an aspect, a premature stop codon can arise from a substitution, missense or nonsense mutation. In an aspect, a nonsense, missense or frameshift mutation provided herein is located in an exon of a br2 gene. In an aspect, a substitution, insertion or deletion provided herein is located in a gene element selected from the group consisting of an exon and an intron/exon splice site. A substitution, insertion or deletion provided herein can generate a protein with one or more, two or more, three or more, four or more, five or more, six or more, seven or more, eight or more, nine or more, or ten or more nonsense mutations. According to present embodiments, a premature stop codon may be introduced into the coding sequence of an endogenous br2 gene via a targeted editing technique and/or site-directed integration. The premature stop codon may be generated via imperfect DNA repair following a double strand break introduced into a br2 gene, or via template-assisted repair following introduction of the double strand break using a DNA donor template comprising the premature stop codon. Such a DNA donor template may further comprise one or more flanking homologous arms or sequences that are identical, homologous or complementary to a corresponding sequence of the endogenous br2 gene to help promote recombination between the donor template and the target site in the endogenous br2 gene for insertion of a sequence comprising the premature stop codon at the desired target site.

In an aspect, a premature stop codon is positioned within the first exon of an endogenous br2 locus. In an aspect, a premature stop codon is positioned within the second exon of an endogenous br2 locus. In an aspect, a premature stop codon is positioned within the third exon of an endogenous br2 locus. In an aspect, a premature stop codon is positioned within the fourth exon of an endogenous br2 locus. In an aspect, a premature stop codon is positioned within the fifth exon of an endogenous br2 locus.

In an aspect, a mutant allele provided herein encodes a truncated protein as compared to SEQ ID NO: 181. As used herein, a "truncated" protein or polypeptide comprises at least one fewer amino acid as compared to an endogenous control protein or polypeptide. For example, if endogenous Protein A comprises 100 amino acids, a truncated version of Protein A can comprise between 1 and 99 amino acids.

In an aspect, this disclosure provides a modified corn plant, or plant part thereof, comprising a premature stop codon within a nucleic acid sequence encoding a Brachytic2 protein as compared to a nucleic acid sequence of a control corn plant or plant part thereof. In an aspect, this disclosure provides a modified corn plant, or plant part thereof, comprising a premature stop codon within a nucleic acid sequence encoding a Brachytic2 protein. In an aspect, this disclosure provides a modified corn plant, or plant part thereof, comprising a truncated Brachytic2 protein encoded by a nucleic acid sequence comprising a premature stop codon as compared to a wildtype or control nucleic acid sequence. In an aspect, this disclosure provides a modified corn plant, or plant part thereof, comprising a premature stop codon in a nucleic acid sequence as compared to SEQ ID NO: 180.

In an aspect, a premature stop codon is positioned within a region of a br2 mRNA transcript selected from the group consisting of the first exon, the second exon, the third exon, the fourth exon, and the fifth exon.

In an aspect, a truncated Br2 protein sequence comprises fewer than 1378 amino acids. In an aspect, a truncated Br2 protein sequence comprises fewer than 1375 amino acids. In an aspect, a truncated Br2 protein sequence comprises fewer than 1350 amino acids. In an aspect, a truncated Br2 protein sequence comprises fewer than 1300 amino acids. In an aspect, a truncated Br2 protein sequence comprises fewer than 1200 amino acids. In an aspect, a truncated Br2 protein sequence comprises fewer than 1100 amino acids. In an aspect, a truncated Br2 protein sequence comprises fewer than 1000 amino acids. In an aspect, a truncated Br2 protein sequence comprises fewer than 900 amino acids. In an aspect, a truncated Br2 protein sequence comprises fewer than 800 amino acids. In an aspect, a truncated Br2 protein sequence comprises fewer than 700 amino acids. In an aspect, a truncated Br2 protein sequence comprises fewer than 600 amino acids. In an aspect, a truncated Br2 protein sequence comprises fewer than 500 amino acids. In an aspect, a truncated Br2 protein sequence comprises fewer than 400 amino acids. In an aspect, a truncated Br2 protein sequence comprises fewer than 300 amino acids. In an aspect, a truncated Br2 protein sequence comprises fewer than 200 amino acids. In an aspect, a truncated Br2 protein sequence comprises fewer than 100 amino acids. In an aspect, a truncated Br2 protein sequence comprises fewer than 50 amino acids.

In an aspect, a truncated Br2 protein sequence comprises between 1 amino acid and 1378 amino acids. In an aspect, a truncated Br2 protein sequence comprises between 25 amino acids and 1378 amino acids. In an aspect, a truncated Br2 protein sequence comprises between 50 amino acids and 1378 amino acids. In an aspect, a truncated Br2 protein sequence comprises between 100 amino acids and 1378 amino acids. In an aspect, a truncated Br2 protein sequence comprises between 250 amino acids and 1378 amino acids. In an aspect, a truncated Br2 protein sequence comprises between 500 amino acids and 1378 amino acids. In an aspect, a truncated Br2 protein sequence comprises between 750 amino acids and 1378 amino acids. In an aspect, a truncated Br2 protein sequence comprises between 1000 amino acids and 1378 amino acids. In an aspect, a truncated Br2 protein sequence comprises between 1250 amino acids and 1378 amino acids. In an aspect, a truncated Br2 protein sequence comprises between 100 amino acids and 1000 amino acids. In an aspect, a truncated Br2 protein sequence comprises between 250 amino acids and 1000 amino acids. In an aspect, a truncated Br2 protein sequence comprises between 500 amino acids and 1000 amino acids. In an aspect, a truncated Br2 protein sequence comprises between 750 amino acids and 1000 amino acids. In an aspect, a truncated Br2 protein sequence comprises between 1000 amino acids and 1378 amino acids.

In an aspect, a mutant allele of an endogenous br2 locus suppresses the expression of a wild-type allele of the endogenous br2 locus.

In an aspect, an RNA transcript comprises one or more sequence elements of the endogenous br2 locus selected from the group consisting of 5'-UTR, first exon, first intron, second exon, second intron, third exon, third intron, fourth exon, fourth intron, fifth exon, 3'-UTR, and any portion thereof. In an aspect, an endogenous sequence of an RNA transcript is at least 85%, at least 90%, at least 91%, at least 92%, at least 93%, at least 94%, at least 95%, at least 96%, at least 97%, at least 98%, at least 99%, or 100% identical to at least 20, at least 30, at least 40, at least 50, at least 100, at least 200, at least 300, at least 400, at least 500, at least 600, at least 700, at least 800, at least 900, or at least 1000 consecutive nucleotides of SEQ ID NOs: 132 or 180.

In an aspect, a DNA segment comprises a nucleotide sequence originating from the endogenous br2 locus. In an aspect, a DNA segment comprises an inverted genomic fragment of the endogenous br2 locus. In an aspect, a DNA segment is inserted near or adjacent to a corresponding endogenous DNA segment of an endogenous br2 locus. In an aspect, a DNA segment is inserted within a region selected from the group consisting of the 5' untranslated region (UTR), first exon, first intron, second exon, second intron, third exon, third intron, fourth exon, fourth intron, fifth exon, and 3' UTR of an endogenous br2 locus, and a combination thereof. In an aspect, the sense strand of a DNA segment comprises a sequence that is at least 70%, at least 80%, at least 85%, at least 90%, at least 91%, at least 92%, at least 93%, at least 94%, at least 95%, at least 96%, at least 97%, at least 98%, at least 99%, or 100% identical or complementary to an exon sequence of an endogenous br2 locus. In an aspect, the sense strand of a DNA segment comprises a sequence at least 70%, at least 80%, at least 85%, at least 90%, at least 91%, at least 92%, at least 93%, at least 94%, at least 95%, at least 96%, at least 97%, at least 98%, at least 99%, or 100% identical or complementary to an untranslated region (UTR) sequence of the endogenous br2 locus. In an aspect, the sense strand of a DNA segment comprises a sequence at least 70%, at least 80%, at least 85%, at least 90%, at least 91%, at least 92%, at least 93%, at least 94%, at least 95%, at least 96%, at least 97%, at least 98%, at least 99%, or 100% identical or complementary to an exon sequence and an intron sequence of the endogenous br2 locus, the exon sequence and the intron sequence being contiguous within the endogenous locus. In an aspect, a DNA segment comprises a sequence having at least 70%, at least 80%, at least 85%, at least 90%, at least 91%, at least 92%, at least 93%, at least 94%, at least 95%, at least 96%, at least 97%, at least 98%, at least 99%, or 100% identical or complementary to SEQ ID NOs: 132 or 180.

In an aspect, a mutant allele encodes a truncated Br2 protein as compared to SEQ ID NO: 181. In an aspect, a truncated Br2 protein is at least 1, at least 2, at least 3, at least 4, at least 5, at least 10, at least 20, at least 30, at least 40, at least 50, at least 60, at least 70, at least 80, at least 90, at least 100, or at least 150 amino acids shorter than the amino acid sequence of SEQ ID NO: 181.

In an aspect, an intervening DNA sequence comprises a native sequence of an endogenous br2 locus. In an aspect, an intervening DNA sequence comprises an exogenous sequence inserted into an endogenous br2 locus.

Without being bound by theory, it is proposed that ectopic expression or overexpression of GA2 oxidase transgene(s) may be effective in achieving a short stature, semi-dwarf phenotype with increased resistance to lodging, but without reproductive off-types in the ear. It is further proposed, without being limited by theory, that restricting the expression of GA2 oxidase gene(s) to certain active GA-producing tissues, such as the vascular and/or leaf tissues of the plant, may be sufficient to produce a short-stature plant with increased lodging resistance, but without significant off-types in reproductive tissues. Expression of a GA2 oxidase transgene in a tissue-specific or tissue-preferred manner may be sufficient and effective at producing plants with the short stature phenotype, while avoiding potential off-types in reproductive tissues that were previously observed with GA mutants in corn (e.g., by avoiding or limiting the expression of the GA2 oxidase gene(s) in those reproductive tissues). For example, the GA2 oxidase transgene(s) may be expressed using a vascular promoter, such as a rice tungro bacilliform virus (RTBV) promoter, that drives expression in vascular tissues of plants. The expression pattern of the RTBV promoter is enriched in vascular tissues of corn plants relative to non-vascular tissues, which is sufficient to produce a semi-dwarf phenotype in corn plants when operably linked to a transcribable DNA sequence encoding a GA2 oxidase gene(s). Lowering of active GA levels in tissue(s) of a corn plant that produce active GAs may reduce plant height and increase lodging resistance, and off-types may be avoided in those plants if active GA levels are not also significantly impacted or lowered in reproductive tissues, such as the developing female organ or ear of the plant. If active GA levels could be reduced in the stalk, stem, or internode(s) of corn plants without significantly affecting GA levels in reproductive tissues (e.g., the female or male reproductive organs or inflorescences), then corn plants having reduced plant height and increased lodging resistance could be created without off-types in the reproductive tissues of the plant.

Thus, recombinant DNA constructs and transgenic plants are provided herein comprising a transcribable DNA sequence encoding a GA2 oxidase mRNA and protein operably linked to a plant expressible promoter, which may be a tissue-specific or tissue-preferred promoter. Such a tissue-specific or tissue-preferred promoter may drive expression of its associated GA2 oxidase coding sequence in one or more active GA-producing tissue(s) of the plant to reduce the level of active GAs produced in those tissue(s). Such a tissue-specific or tissue-preferred promoter may drive expression of its associated GA2 oxidase transgene or coding sequence during one or more vegetative stage(s) of development. Such a tissue-specific or tissue-preferred promoter may also have little or no expression in one or more cell(s) or tissue(s) of the developing female organ or ear of the plant to avoid the possibility of off-types in those reproductive tissues. According to some embodiments, the tissue-specific or tissue-preferred promoter is a vascular promoter, such as the RTBV promoter. The sequence of the RTBV promoter is provided herein as SEQ ID NO: 656, and a truncated version of the RTBV promoter is further provided herein as SEQ ID NO: 657.

Active or bioactive gibberellic acids (i.e., "active gibberellins" or "active GAs") are known in the art for a given plant species, as distinguished from inactive GAs. For example, active GAs in corn and higher plants include the following: GA1, GA3, GA4, and GA7. Thus, an "active GA-producing tissue" is a plant tissue that produces one or more active GAs.

In addition to suppressing GA20 oxidase genes in active GA-producing tissues of the plant with a vascular tissue promoter, it is further proposed that GA2 oxidase transgenes may also be expressed with various constitutive promoters to cause the short, semi-dwarf stature phenotypes in corn, without any visible off-types in the ear. Thus, it is further proposed that expression of one or more GA2 oxidase transgenes could be carried out using a constitutive promoter to create a short stature, lodging-resistant corn plant without any significant or observable reproductive off-types in the plant.

Without being limited by theory, it is proposed that short stature, semi-dwarf phenotypes in corn plants may result from a sufficient level of expression of a GA2 oxidase transgene(s) in active GA-producing tissue(s) of the plant, and restricting the pattern of expression to avoid reproductive ear tissues may not be necessary to avoid reproductive off-types in the developing ear. It is proposed that the semi-dwarf phenotype with GA2 oxidase overexpression can be the result of shortening the stem internodes of the plant. Without being bound by theory, it is proposed that expression of GA2 oxidase transgene(s) in tissue(s) and/or cell(s) of the plant where active GAs are produced, and not necessarily in stem or internode tissue(s), may be sufficient to produce semi-dwarf plants, even though the short stature trait is due to shortening of the stem internodes. Given that GAs can migrate through the vasculature of the plant, it is proposed that manipulating GA oxidase genes in plant tissue(s) where active GAs are produced may result in a short stature, semi-dwarf plant, even though this may be largely achieved by reducing the level of active GAs produced in non-stem tissues (i.e., away from the site of action in the stem where reduced internode elongation leads to the semi-dwarf phenotype). However, without being bound by theory, expression of a GA2 oxidase transgene at low levels, and/or in a limited number of plant tissues, may be insufficient to cause a significant short stature, semi-dwarf phenotype.

The plant hormone gibberellin plays an important role in a number of plant developmental processes including germination, cell elongation, flowering, embryogenesis and seed development. Certain biosynthetic enzymes (e.g., GA20 oxidase and GA3 oxidase) and catabolic enzymes (e.g., GA2 oxidase) in the GA pathway are critical to affecting active GA levels in plant tissues. While the biosynthetic enzymes can increase the level of active GAs, the catabolic enzymes can reduce the level(s) of active GAs in plants or plant cells. Thus, it is proposed that overexpression or ectopic expression of a GA2 oxidase transgene in a constitutive or tissue-specific or tissue-preferred manner may produce corn plants having a short stature phenotype and increased lodging resistance, with possible increased yield, but without off-types in the ear. Thus, according to some embodiments, constructs and transgenes are provided comprising a transcribable DNA sequence encoding a GA2 oxidase protein operably linked to a constitutive or tissue-specific or tissue-preferred promoter, such as a vascular or leaf promoter. According to some embodiments, the tissue-specific or tissue-preferred promoter is a vascular promoter, such as the RTBV promoter. However, other types of tissue-specific or tissue preferred promoters may potentially be used for GA2 oxidase expression in active GA-producing tissues of a corn plant to produce a semi-dwarf phenotype without significant off-types.

According to some embodiments, a modified or transgenic plant is provided having a GA2 oxidase gene expression level that is increased in at least one plant tissue by at least 5%, at least 10%, at least 20%, at least 25%, at least 30%, at least 40%, at least 50%, at least 60%, at least 70%, at least 75%, at least 80%, at least 90%, or 100%, as compared to a control plant. According to some embodiments, a modified or transgenic plant is provided having a GA2 oxidase gene expression level that is increased in at least one plant tissue by 5%-20%, 5%-25%, 5%-30%, 5%-40%, 5%-50%, 5%-60%, 5%-70%, 5%-75%, 5%-80%, 5%-90%, 5%-100%, 75%-100%, 50%-100%, 50%-90%, 50%-75%, 25%-75%, 30%-80%, or 10%-75%, as compared to a control plant. According to these embodiments, the at least one tissue of a modified or transgenic plant having an increased expression level of a GA2 oxidase gene(s) includes one or more active GA producing tissue(s) of the plant, such as the vascular and/or leaf tissue(s) of the plant, during one or more vegetative stage(s) of development.

In some embodiments, transgenic expression of a GA2 oxidase transgene is constitutive or tissue-specific (e.g., only in leaf and/or vascular tissue). For example, expression of a GA2 oxidase transgene may be vascular or leaf tissue specific or preferred. In other embodiments, expression of a GA2 oxidase transgene is constitutive and not tissue-specific. According to some embodiments, expression of a GA2 oxidase transgene is increased in one or more tissue types (e.g., in leaf and/or vascular tissue(s)) of a modified or transgenic plant as compared to the same tissue(s) of a control plant.

According to embodiments of the present disclosure, a recombinant DNA molecule, construct or vector is provided comprising an expression cassette comprising a GA2 oxidase coding sequence or transcribable DNA sequence that is operably linked to a plant-expressible constitutive or tissue-specific or tissue-preferred promoter. The expression cassette may comprise a transcribable DNA sequence having a percent identity to all or part of a GA2 oxidase gene or coding sequence. A transgene having a coding sequence with a lower percent identity to all or part of a GA2 oxidase gene may encode a protein having or retaining a GA catabolic activity in a corn plant or plant cell similar to GA2 oxidase genes in general.

A single GA2 oxidase transgene or expression cassette may be present in a construct, molecule or vector, or multiple GA2 oxidase transgenes or expression cassettes may be arranged serially in tandem or arranged in tandem segments or repeats, in a construct, molecule or vector, which may also be interrupted by one or more spacer sequence(s). The sequence of each transgene or expression cassette may encode a GA2 oxidase mRNA and protein. A transcribable DNA sequence or coding sequence of a GA2 oxidase transgene may encode a protein having at least 70%, at least 75%, at least 80%, at least 85%, at least 90%, at least 95%, at least 96%, at least 97%, at least 98%, at least 99%, at least 99.5% or 100% identity to all or part of a GA2 oxidase gene sequence.

According to embodiments of the present disclosure, a recombinant DNA molecule, construct or vector is provided comprising a transcribable DNA sequence encoding a GA2 oxidase. According to some embodiments, a recombinant DNA molecule, vector or construct is provided comprising a transcribable DNA sequence encoding a GA2 oxidase mRNA and protein in a plant cell, and wherein the transcribable DNA sequence is operably linked to a plant-expressible promoter, such as a constitutive or tissue-specific or tissue-preferred promoter. According to embodiments of the present disclosure, suitable tissue-specific or tissue preferred promoters for expression of a GA2 oxidase may include those promoters that drive or cause expression of its associated suppression element or sequence at least in the vascular and/or leaf tissue(s) of a corn plant. Expression of the GA2 oxidase with a tissue-specific or tissue-preferred promoter may also occur in other tissues of the corn plant outside of the vascular and leaf tissues, but active GA levels in the developing reproductive tissues of the plant (particularly in the female reproductive organ or ear) are preferably not significantly reduced or impacted (relative to wild type or control plants), such that development of the female organ or ear may proceed normally in the transgenic plant without off-types in the ear and a loss in yield potential. According to many embodiments, the plant-expressible promoter may preferably drive expression constitutively or in at least a portion of the vascular and/or leaf tissues of the plant. However, some tissue-specific and tissue-preferred promoters driving expression of a GA2 oxidase transgene in a plant may not produce a significant short stature or anti-lodging phenotypes due to the spatial-temporal pattern of expression of the promoter during plant development, and/or the amount or strength of expression of the promoter being too low or weak. A sufficient level of expression of a transcribable DNA sequence encoding a GA2 oxidase may be necessary to produce a short stature, semi-dwarf phenotype that resists lodging, since lower levels of expression may be insufficient to lower active GA levels in the plant to a sufficient extent to cause a significant phenotype. Thus, tissue-specific and tissue-preferred promoters that drive, etc., a moderate or strong level of expression of their associated transcribable DNA sequence in active GA-producing tissue(s) of a plant may be preferred. Furthermore, such tissue-specific and tissue-preferred should drive, etc., expression of their associated transcribable DNA sequence during one or more vegetative stage(s) of plant development when the plant is growing and/or elongating including one or more of the following vegetative stage(s): $V_E$, V1, V2, V3, V4, V5, V6, V7, V8, V9, V10, V11, V12, V13, V14, Vn, $V_T$, such as expression at least during V3-V12, V4-V12, V5-V12, V6-V12, V7-V12, V8-V12, V3-V14, V5-V14, V6-V14, V7-V14, V8-V14, V9-V14, V10-V14, etc., or during any other range of vegetative stages when growth and/or elongation of the plant is occurring.

Any vascular promoters known in the art may potentially be used as the tissue-specific or tissue-preferred promoter. Examples of vascular promoters include the RTBV promoter (see, e.g., SEQ ID NO: 656), a known sucrose synthase gene promoter, such as a corn sucrose synthase-1 (Sus1 or Sh1) promoter (see, e.g., SEQ ID NO: 658), a corn Sh1 gene paralog promoter, a barley sucrose synthase promoter (Ss1) promoter, a rice sucrose synthase-1 (RSs1) promoter (see, e.g., SEQ ID NO: 659), or a rice sucrose synthase-2 (RSs2) promoter (see, e.g., SEQ ID NO: 660), a known sucrose transporter gene promoter, such as a rice sucrose transporter promoter (SUT1) (see, e.g., SEQ ID NO: 661), or various known viral promoters, such as a Commelina yellow mottle virus (CoYMV) promoter, a wheat dwarf geminivirus (WDV) large intergenic region (LIR) promoter, a maize streak geminivirus (MSV) coat protein (CP) promoter, or a rice yellow stripe 1 (YS1)-like or OsYSL2 promoter (SEQ ID NO: 662), and any functional sequence portion or truncation of any of the foregoing promoters with a similar pattern of expression, such as a truncated RTBV promoter (see, e.g., SEQ ID NO: 657). Any other vascular promoters known in the art may also be used, including promoter sequences from related genes (e.g., sucrose synthase, sucrose transporter, and viral gene promoter sequences) from the same or different plant species, microbe or virus that have a similar pattern of expression. Further provided are promoter sequences with a high degree of homology to any of the foregoing. For example, a vascular promoter may comprise a DNA sequence that is at least at least 70%, at least 80%, at least 85%, at least 90%, at least 95%, at least 96%, at least 97%, at least 98%, at least 99%, at least 99.5% or 100% identical to one or more of SEQ ID NOs: 656, 657, 658, 659, 660, 661, and 662, any functional sequence portion or truncation thereof, and/or any sequence complementary to any of the foregoing sequences. Examples of vascular promoters may further include other known, engineered and/or later-identified promoter sequences shown to have a pattern of expression in vascular tissue(s) of a corn plant.

Any leaf promoters known in the art may potentially be used as the tissue-specific or tissue-preferred promoter. Examples of leaf promoters include a corn pyruvate phosphate dikinase or PPDK promoter (see, e.g., SEQ ID NO: 663), a corn fructose 1,6 bisphosphate aldolase or FDA promoter (see, e.g., SEQ ID NO: 664), and a rice Nadh-Gogat promoter (see, e.g., SEQ ID NO: 665), and any functional sequence portion or truncation of any of the foregoing promoters with a similar pattern of expression. Other examples of leaf promoters from monocot plant genes include a ribulose biphosphate carboxylase (RuBisCO) or RuBisCO small subunit (RBCS) promoter, a chlorophyll a/b binding protein gene promoter, a phosphoenolpyruvate carboxylase (PEPC) promoter, and a Myb gene promoter, and any functional sequence portion or truncation of any of these promoters with a similar pattern of expression. Any other leaf promoters known in the art may also be used, including promoter sequences from related genes from the same or different plant species, microbe or virus that have a similar pattern of expression. Further provided are promoter sequences with a high degree of homology to any of the foregoing. For example, a leaf promoter may comprise a DNA sequence that is at least at least 70%, at least 80%, at least 85%, at least 90%, at least 95%, at least 96%, at least 97%, at least 98%, at least 99%, at least 99.5% or 100% identical to one or more of SEQ ID NOs: 663, 664, and 665, any functional sequence portion or truncation thereof, and/or any sequence complementary to any of the foregoing sequences. Examples of leaf promoters may further include other known, engineered and/or later-identified promoter sequences shown to have a pattern of expression in leaf tissue(s) of a corn plant.

Any constitutive promoters known in the art may potentially be used. Examples of constitutive promoters that may be used in corn plants include, for example, various actin gene promoters, such as a rice Actin 1 promoter (see, e.g., U.S. Pat. No. 5,641,876; see also SEQ ID NO: 666 or SEQ ID NO: 667) and a rice Actin 2 promoter (see, e.g., U.S. Pat. No. 6,429,357; see also, e.g., SEQ ID NO: 668 or SEQ ID NO: 669), a CaMV 35S or 19S promoter (see, e.g., U.S. Pat. No. 5,352,605; see also, e.g., SEQ ID NO: 670 for CaMV 35S), a maize ubiquitin promoter (see, e.g., U.S. Pat. No. 5,510,474), a *Coix lacryma-jobi* polyubiquitin promoter (see, e.g., SEQ ID NO: 671), a rice or maize Gos2 promoter (see, e.g., Pater et al., The Plant Journal, 2(6): 837-44 1992; see also, e.g., SEQ ID NO: 672 for the rice Gos2 promoter), a FMV 35S promoter (see, e.g., U.S. Pat. No. 6,372,211), a dual enhanced CMV promoter (see, e.g., U.S. Pat. No. 5,322,938), a MMV promoter (see, e.g., U.S. Pat. No. 6,420,547; see also, e.g., SEQ ID NO: 673), a PCLSV promoter (see, e.g., U.S. Pat. No. 5,850,019; see also, e.g., SEQ ID NO: 674), an Emu promoter (see, e.g., Last et al., Theor. Appl. Genet. 81:581 (1991); and Mcelroy et al., Mol. Gen. Genet. 231:150 (1991)), a tubulin promoter from maize, rice or other species, a nopaline synthase (nos) promoter, an octopine synthase (ocs) promoter, a mannopine synthase (mas) promoter, or a plant alcohol dehydrogenase (e.g., maize Adh1) promoter, any other promoters including viral promoters known or later-identified in the art to provide constitutive expression in a corn plant, any other constitutive promoters known in the art that may be used in corn plants, and any functional sequence portion or truncation of any of the foregoing promoters.

Any other constitutive promoters known in the art may also be used, including promoter sequences from related genes from the same or different plant species, microbe or virus that have a similar pattern of expression. Further provided are promoter sequences with a high degree of homology to any of the foregoing. For example, a constitutive promoter may comprise a DNA sequence that is at least at least 70%, at least 80%, at least 85%, at least 90%, at least 95%, at least 96%, at least 97%, at least 98%, at least 99%, at least 99.5% or 100% identical to one or more of SEQ ID NOs: 666, 667, 668, 669, 670, 671, 672, 673, and 674, any functional sequence portion or truncation thereof, and/or any sequence complementary to any of the foregoing sequences. Examples of constitutive promoters may further include other known, engineered and/or later-identified promoter sequences shown to have a constitutive pattern of expression in a corn plant. Furthermore, any known or later-identified constitutive promoter may also be used.

According to embodiments of the present disclosure, a recombinant DNA molecule, construct or vector is provided comprising a transcribable DNA sequence encoding a GA2 oxidase protein from a monocot or cereal plant, such as a corn plant, or encoding a GA2 oxidase protein having at least a certain percent homology to a GA2 oxidase protein from a monocot or cereal plant, such as a corn plant. A family of at least thirteen GA2 oxidase genes have been identified in corn (*Zea mays*) including Zm.GA2 oxidase_1, Zm.GA2 oxidase_2, Zm.GA2 oxidase_3, Zm.GA2 oxidase_4, Zm.GA2 oxidase_5, Zm.GA2 oxidase_6, Zm.GA2 oxidase_7, Zm.GA2 oxidase_8, Zm.GA2 oxidase_9, Zm.GA2 oxidase_10, Zm.GA2 oxidase_11, Zm.GA2 oxidase_12, and Zm.GA2 oxidase_13. The DNA and protein sequences by SEQ ID NO for each of these GA2 oxidase genes are provided in Table 3.

TABLE 3

DNA and protein sequences for GA2 oxidase genes in corn.

| GA2 oxidase Gene | Coding Sequence (CDS) | Protein |
|---|---|---|
| Zm.GA2 oxidase_1 | SEQ ID NO: 324 | SEQ ID NO: 325 |
| Zm.GA2 oxidase_2 | SEQ ID NO: 326 | SEQ ID NO: 327 |
| Zm.GA2 oxidase_3 | SEQ ID NO: 328 | SEQ ID NO: 329 |
| Zm.GA2 oxidase_4 | SEQ ID NO: 330 | SEQ ID NO: 331 |
| Zm.GA2 oxidase_5 | SEQ ID NO: 332 | SEQ ID NO: 333 |
| Zm.GA2 oxidase_6 | SEQ ID NO: 334 | SEQ ID NO: 335 |
| Zm.GA2 oxidase_7 | SEQ ID NO: 336 | SEQ ID NO: 337 |
| Zm.GA2 oxidase_8 | SEQ ID NO: 338 | SEQ ID NO: 339 |
| Zm.GA2 oxidase_9 | SEQ ID NO: 340 | SEQ ID NO: 341 |
| Zm.GA2 oxidase_10 | SEQ ID NO: 342 | SEQ ID NO: 343 |
| Zm.GA2 oxidase_11 | SEQ ID NO: 344 | SEQ ID NO: 345 |
| Zm.GA2 oxidase_12 | SEQ ID NO: 346 | SEQ ID NO: 347 |
| Zm.GA2 oxidase_13 | SEQ ID NO: 348 | SEQ ID NO: 349 |

GA2 oxidase genes from other monocot or cereal plant species may also be used, such as rice, barley, wheat and sorghum. According to embodiments of the present disclosure, a recombinant DNA molecule, construct or vector is provided comprising a transcribable DNA sequence encoding a GA2 oxidase protein from a monocot or cereal plant other than corn, or encoding a GA2 oxidase protein having at least a certain percent homology to a GA2 oxidase protein from a monocot or cereal plant other than corn. A family of at least ten GA2 oxidase genes have been identified in rice (*Oryza sativa*) plants including Os.GA2 oxidase_1, Os.GA2 oxidase_2, Os.GA2 oxidase_3, Os.GA2 oxidase_4, Os.GA2 oxidase_5, Os.GA2 oxidase_6, Os.GA2 oxidase_7, Os.GA2 oxidase_8, Os.GA2 oxidase_9, and Os.GA2 oxidase_10. The DNA and protein sequences by SEQ ID NO for each of these GA2 oxidase genes are provided in Table 4.

TABLE 4

DNA and protein sequences for GA2 oxidase genes in rice.

| GA2 oxidase Gene | Coding Sequence (CDS) | Protein |
|---|---|---|
| Os.GA2 oxidase_1 | SEQ ID NO: 350 | SEQ ID NO: 351 |
| Os.GA2 oxidase_2 | SEQ ID NO: 352 | SEQ ID NO: 353 |
| Os.GA2 oxidase_3 | SEQ ID NO: 354 | SEQ ID NO: 355 |
| Os.GA2 oxidase_4 | SEQ ID NO: 356 | SEQ ID NO: 357 |
| Os.GA2 oxidase_5 | SEQ ID NO: 358 | SEQ ID NO: 359 |
| Os.GA2 oxidase_6 | SEQ ID NO: 360 | SEQ ID NO: 361 |
| Os.GA2 oxidase_7 | SEQ ID NO: 362 | SEQ ID NO: 363 |
| Os.GA2 oxidase_8 | SEQ ID NO: 364 | SEQ ID NO: 365 |
| Os.GA2 oxidase_9 | SEQ ID NO: 366 | SEQ ID NO: 367 |
| Os.GA2 oxidase_10 | SEQ ID NO: 368 | SEQ ID NO: 369 |

A family of at least eight GA2 oxidase genes have been identified in barley (*Hordeum vulgare*) plants including Hv.GA2 oxidase_1, Hv.GA2 oxidase_2, Hv.GA2 oxidase_3, Hv.GA2 oxidase_4, Hv.GA2 oxidase_5, Hv.GA2 oxidase_6, Hv.GA2 oxidase_7, and Hv.GA2 oxidase_8. The DNA and protein sequences by SEQ ID NO for each of these GA2 oxidase genes are provided in Table 5.

TABLE 5

DNA and protein sequences for GA2 oxidase genes in barley.

| GA2 oxidase Gene | Coding Sequence (CDS) | Protein |
|---|---|---|
| Hv.GA2 oxidase_1 | SEQ ID NO: 370 | SEQ ID NO: 371 |
| Hv.GA2 oxidase_2 | SEQ ID NO: 372 | SEQ ID NO: 373 |
| Hv.GA2 oxidase_3 | SEQ ID NO: 374 | SEQ ID NO: 375 |
| Hv.GA2 oxidase_4 | SEQ ID NO: 376 | SEQ ID NO: 377 |
| Hv.GA2 oxidase_5 | SEQ ID NO: 378 | SEQ ID NO: 379 |
| Hv.GA2 oxidase_6 | SEQ ID NO: 380 | SEQ ID NO: 381 |
| Hv.GA2 oxidase_7 | SEQ ID NO: 382 | SEQ ID NO: 383 |
| Hv.GA2 oxidase_8 | SEQ ID NO: 384 | SEQ ID NO: 385 |

A family of at least sixteen GA2 oxidase genes have been identified in sorghum (*Sorghum bicolor*) plants including Hv.GA2 oxidase_1, Sb.GA2 oxidase_2, Sb.GA2 oxidase_3, Sb.GA2 oxidase_4, Sb.GA2 oxidase_5, Sb.GA2 oxidase_6, Sb.GA2 oxidase_7, Sb.GA2 oxidase_8, Sb.GA2 oxidase_9, Sb.GA2 oxidase_10, Sb.GA2 oxidase_11, Sb.GA2 oxidase_12, Sb.GA2 oxidase_13, Sb.GA2 oxidase_14, Sb.GA2 oxidase_15, and Sb.GA2 oxidase_16. The DNA and protein sequences by SEQ ID NO for each of these GA2 oxidase genes are provided in Table 6.

TABLE 6

| DNA and protein sequences for GA2 oxidase genes in sorghum. | | |
|---|---|---|
| GA2 oxidase Gene | Coding Sequence (CDS) | Protein |
| Sb.GA2 oxidase_1 | SEQ ID NO: 386 | SEQ ID NO: 387 |
| Sb.GA2 oxidase_2 | SEQ ID NO: 388 | SEQ ID NO: 389 |
| Sb.GA2 oxidase_3 | SEQ ID NO: 390 | SEQ ID NO: 391 |
| Sb.GA2 oxidase_4 | SEQ ID NO: 392 | SEQ ID NO: 393 |
| Sb.GA2 oxidase_5 | SEQ ID NO: 394 | SEQ ID NO: 395 |
| Sb.GA2 oxidase_6 | SEQ ID NO: 396 | SEQ ID NO: 397 |
| Sb.GA2 oxidase_7 | SEQ ID NO: 398 | SEQ ID NO: 399 |
| Sb.GA2 oxidase_8 | SEQ ID NO: 400 | SEQ ID NO: 401 |
| Sb.GA2 oxidase_9 | SEQ ID NO: 402 | SEQ ID NO: 403 |
| Sb.GA2 oxidase_10 | SEQ ID NO: 404 | SEQ ID NO: 405 |
| Sb.GA2 oxidase_11 | SEQ ID NO: 406 | SEQ ID NO: 407 |
| Sb.GA2 oxidase_12 | SEQ ID NO: 408 | SEQ ID NO: 409 |
| Sb.GA2 oxidase_13 | SEQ ID NO: 410 | SEQ ID NO: 411 |
| Sb.GA2 oxidase_14 | SEQ ID NO: 412 | SEQ ID NO: 413 |
| Sb.GA2 oxidase_15 | SEQ ID NO: 414 | SEQ ID NO: 415 |
| Sb.GA2 oxidase_16 | SEQ ID NO: 416 | SEQ ID NO: 417 |

A family of at least fifteen GA2 oxidase genes have been identified in wheat (*Triticum aestivum*) including Ta.GA2 oxidase_1, Ta.GA2 oxidase_2, Ta.GA2 oxidase_3, Ta.GA2 oxidase_4, Ta.GA2 oxidase_5, Ta.GA2 oxidase_6, Ta.GA2 oxidase_7, Ta.GA2 oxidase_8, Ta.GA2 oxidase_9, Ta.GA2 oxidase_10, Ta.GA2 oxidase_11, Ta.GA2 oxidase_12, Ta.GA2 oxidase_13, Ta.GA2 oxidase_14, and Ta.GA2 oxidase_15. The DNA and protein sequences by SEQ ID NO for each of these GA2 oxidase genes from wheat are provided in Table 7.

TABLE 7

| DNA and protein sequences for GA2 oxidase genes in wheat. | | |
|---|---|---|
| GA2 oxidase Gene | Coding Sequence (CDS) | Protein |
| Ta.GA2 oxidase_1 | SEQ ID NO: 418 | SEQ ID NO: 419 |
| Ta.GA2 oxidase_2 | SEQ ID NO: 420 | SEQ ID NO: 421 |
| Ta.GA2 oxidase_3 | SEQ ID NO: 422 | SEQ ID NO: 423 |
| Ta.GA2 oxidase_4 | SEQ ID NO: 424 | SEQ ID NO: 425 |
| Ta.GA2 oxidase_5 | SEQ ID NO: 426 | SEQ ID NO: 427 |
| Ta.GA2 oxidase_6 | SEQ ID NO: 428 | SEQ ID NO: 429 |
| Ta.GA2 oxidase_7 | SEQ ID NO: 430 | SEQ ID NO: 431 |
| Ta.GA2 oxidase_8 | SEQ ID NO: 432 | SEQ ID NO: 433 |
| Ta.GA2 oxidase_9 | SEQ ID NO: 434 | SEQ ID NO: 435 |
| Ta.GA2 oxidase_10 | SEQ ID NO: 436 | SEQ ID NO: 437 |
| Ta.GA2 oxidase_11 | SEQ ID NO: 438 | SEQ ID NO: 439 |
| Ta.GA2 oxidase_12 | SEQ ID NO: 440 | SEQ ID NO: 441 |
| Ta.GA2 oxidase_13 | SEQ ID NO: 442 | SEQ ID NO: 443 |
| Ta.GA2 oxidase_14 | SEQ ID NO: 444 | SEQ ID NO: 445 |
| Ta.GA2 oxidase_15 | SEQ ID NO: 446 | SEQ ID NO: 447 |

In addition to the corn sequences listed in Table 3, a family of at least eleven GA2 oxidase genes have been identified in another corn (*Zea Mays*) A germplasm line including Zm2.GA2 oxidase_1, Zm2.GA2 oxidase_2, Zm2.GA2 oxidase_3, Zm2.GA2 oxidase_4, Zm2.GA2 oxidase_5, Zm2.GA2 oxidase_6, Zm2.GA2 oxidase_7, Zm2.GA2 oxidase_8, Zm2.GA2 oxidase_9, Zm2.GA2 oxidase_10, and Zm2.GA2 oxidase_11. The DNA and protein sequences by SEQ ID NO for each of these GA2 oxidase genes are provided in Table 8.

TABLE 8

| Additional DNA and protein sequences for GA2 oxidase genes in corn. | | |
|---|---|---|
| GA2 oxidase Gene | Coding Sequence (CDS) | Protein |
| Zm2.GA2 oxidase_1 | SEQ ID NO: 448 | SEQ ID NO: 449 |
| Zm2.GA2 oxidase_2 | SEQ ID NO: 450 | SEQ ID NO: 451 |

TABLE 8-continued

| Additional DNA and protein sequences for GA2 oxidase genes in corn. | | |
|---|---|---|
| GA2 oxidase Gene | Coding Sequence (CDS) | Protein |
| Zm2.GA2 oxidase_3 | SEQ ID NO: 452 | SEQ ID NO: 453 |
| Zm2.GA2 oxidase_4 | SEQ ID NO: 454 | SEQ ID NO: 455 |
| Zm2.GA2 oxidase_5 | SEQ ID NO: 456 | SEQ ID NO: 457 |
| Zm2.GA2 oxidase_6 | SEQ ID NO: 458 | SEQ ID NO: 459 |
| Zm2.GA2 oxidase_7 | SEQ ID NO: 460 | SEQ ID NO: 461 |
| Zm2.GA2 oxidase_8 | SEQ ID NO: 462 | SEQ ID NO: 463 |
| Zm2.GA2 oxidase_9 | SEQ ID NO: 464 | SEQ ID NO: 465 |
| Zm2.GA2 oxidase_10 | SEQ ID NO: 466 | SEQ ID NO: 467 |
| Zm2.GA2 oxidase_11 | SEQ ID NO: 468 | SEQ ID NO: 469 |

According to embodiments of the present disclosure, a recombinant DNA molecule, construct or vector is provided comprising a transcribable DNA sequence encoding a GA2 oxidase protein from a dicot plant, such as a soybean, cotton, canola, *Arabidopsis*, moss (*Physcomitrella patens*), common bean (*Phaseolus vulgaris*), cottonwood (*Populus trichocarpa*), barrel clover (*Medicago truncatula*), pea (*Pisum sativum*), spinach (*Spinacia oleracea*) or whorled honey flower (*Paris polyphylla*) plant, or encoding a GA2 oxidase protein having at least a certain percent homology to a GA2 oxidase protein from a monocot or cereal plant, such as a corn plant.

A family of at least sixteen GA2 oxidase genes have been identified in soybean (*Glycine max*) including Gm.GA2 oxidase_1, Gm.GA2 oxidase_2, Gm.GA2 oxidase_3, Gm.GA2 oxidase_4, Gm.GA2 oxidase_5, Gm.GA2 oxidase_6, Gm.GA2 oxidase_7, Gm.GA2 oxidase_8, Gm.GA2 oxidase_9, Gm.GA2 oxidase_10, Gm.GA2 oxidase_11, Gm.GA2 oxidase_12, Gm.GA2 oxidase_13, Gm.GA2 oxidase_14, Gm.GA2 oxidase_15, and Gm.GA2 oxidase_16. The DNA and protein sequences by SEQ ID NO for each of these GA2 oxidase genes from soybean are provided in Table 9.

TABLE 9

| Additional DNA and protein sequences for GA2 oxidase genes in soybean. | | |
|---|---|---|
| GA2 oxidase Gene | Coding Sequence (CDS) | Protein |
| Gm.GA2 oxidase_1 | SEQ ID NO: 470 | SEQ ID NO: 471 |
| Gm.GA2 oxidase_2 | SEQ ID NO: 472 | SEQ ID NO: 473 |
| Gm.GA2 oxidase_3 | SEQ ID NO: 474 | SEQ ID NO: 475 |
| Gm.GA2 oxidase_4 | SEQ ID NO: 476 | SEQ ID NO: 477 |
| Gm.GA2 oxidase_5 | SEQ ID NO: 478 | SEQ ID NO: 479 |
| Gm.GA2 oxidase_6 | SEQ ID NO: 480 | SEQ ID NO: 481 |
| Gm.GA2 oxidase_7 | SEQ ID NO: 482 | SEQ ID NO: 483 |
| Gm.GA2 oxidase_8 | SEQ ID NO: 484 | SEQ ID NO: 485 |
| Gm.GA2 oxidase_9 | SEQ ID NO: 486 | SEQ ID NO: 487 |
| Gm.GA2 oxidase_10 | SEQ ID NO: 488 | SEQ ID NO: 489 |
| Gm.GA2 oxidase_11 | SEQ ID NO: 490 | SEQ ID NO: 491 |
| Gm.GA2 oxidase_12 | SEQ ID NO: 492 | SEQ ID NO: 493 |
| Gm.GA2 oxidase_13 | SEQ ID NO: 494 | SEQ ID NO: 495 |
| Gm.GA2 oxidase_14 | SEQ ID NO: 496 | SEQ ID NO: 497 |
| Gm.GA2 oxidase_15 | SEQ ID NO: 498 | SEQ ID NO: 499 |
| Gm.GA2 oxidase_16 | SEQ ID NO: 500 | SEQ ID NO: 501 |

A family of at least fifteen related GA2 oxidase genes have been identified in cotton (*Gossypium hirsutum*) including Gh.GA2 oxidase_1, Gh.GA2 oxidase_2, Gh.GA2 oxidase_3, Gh.GA2 oxidase_4, Gh.GA2 oxidase_5, Gh.GA2 oxidase_6, Gh.GA2 oxidase_7, Gh.GA2 oxidase_8, Gh.GA2 oxidase_9, Gh.GA2 oxidase_10, Gh.GA2 oxidase_11, Gh.GA2 oxidase_12, Gh.GA2 oxidase_13, Gh.GA2 oxidase_14, and Gh.GA2 oxidase_15. The DNA and protein sequences by SEQ ID NO for each of these GA2 oxidase genes from cotton are provided in Table 10.

TABLE 10

DNA and protein sequences for GA2 oxidase genes in cotton.

| GA2 oxidase Gene | Coding Sequence (CDS) | Protein |
|---|---|---|
| Gh.GA2 oxidase_1 | SEQ ID NO: 502 | SEQ ID NO: 503 |
| Gh.GA2 oxidase_2 | SEQ ID NO: 504 | SEQ ID NO: 505 |
| Gh.GA2 oxidase_3 | SEQ ID NO: 506 | SEQ ID NO: 507 |
| Gh.GA2 oxidase_4 | SEQ ID NO: 508 | SEQ ID NO: 509 |
| Gh.GA2 oxidase_5 | SEQ ID NO: 510 | SEQ ID NO: 511 |
| Gh.GA2 oxidase_6 | SEQ ID NO: 512 | SEQ ID NO: 513 |
| Gh.GA2 oxidase_7 | SEQ ID NO: 514 | SEQ ID NO: 515 |
| Gh.GA2 oxidase_8 | SEQ ID NO: 516 | SEQ ID NO: 517 |
| Gh.GA2 oxidase_9 | SEQ ID NO: 518 | SEQ ID NO: 519 |
| Gh.GA2 oxidase_10 | SEQ ID NO: 520 | SEQ ID NO: 521 |
| Gh.GA2 oxidase_11 | SEQ ID NO: 522 | SEQ ID NO: 523 |
| Gh.GA2 oxidase_12 | SEQ ID NO: 524 | SEQ ID NO: 525 |
| Gh.GA2 oxidase_13 | SEQ ID NO: 526 | SEQ ID NO: 527 |
| Gh.GA2 oxidase_14 | SEQ ID NO: 528 | SEQ ID NO: 529 |
| Gh.GA2 oxidase_15 | SEQ ID NO: 530 | SEQ ID NO: 531 |

A family of at least fifteen GA2 oxidase genes have been identified in canola (*Brassica napus*) including Bn.GA2 oxidase_1, Bn.GA2 oxidase_2, Bn.GA2 oxidase_3, Bn.GA2 oxidase_4, Bn.GA2 oxidase_5, Bn.GA2 oxidase_6, Bn.GA2 oxidase_7, Bn.GA2 oxidase_8, Bn.GA2 oxidase_9, Bn.GA2 oxidase_10, Bn.GA2 oxidase_11, Bn.GA2 oxidase_12, Bn.GA2 oxidase_13, Bn.GA2 oxidase_14, and Bn.GA2 oxidase_15. The DNA and protein sequences by SEQ ID NO for each of these GA2 oxidase genes from canola are provided in Table 11.

TABLE 11

DNA and protein sequences for GA2 oxidase genes in canola.

| GA2 oxidase Gene | Coding Sequence (CDS) | Protein |
|---|---|---|
| Bn.GA2 oxidase_1 | SEQ ID NO: 532 | SEQ ID NO: 533 |
| Bn.GA2 oxidase_2 | SEQ ID NO: 534 | SEQ ID NO: 535 |
| Bn.GA2 oxidase_3 | SEQ ID NO: 536 | SEQ ID NO: 537 |
| Bn.GA2 oxidase_4 | SEQ ID NO: 538 | SEQ ID NO: 539 |
| Bn.GA2 oxidase_5 | SEQ ID NO: 540 | SEQ ID NO: 541 |
| Bn.GA2 oxidase_6 | SEQ ID NO: 542 | SEQ ID NO: 543 |
| Bn.GA2 oxidase_7 | SEQ ID NO: 544 | SEQ ID NO: 545 |
| Bn.GA2 oxidase_8 | SEQ ID NO: 546 | SEQ ID NO: 547 |
| Bn.GA2 oxidase_9 | SEQ ID NO: 548 | SEQ ID NO: 549 |
| Bn.GA2 oxidase_10 | SEQ ID NO: 550 | SEQ ID NO: 551 |
| Bn.GA2 oxidase_11 | SEQ ID NO: 552 | SEQ ID NO: 553 |
| Bn.GA2 oxidase_12 | SEQ ID NO: 554 | SEQ ID NO: 555 |
| Bn.GA2 oxidase_13 | SEQ ID NO: 556 | SEQ ID NO: 557 |
| Bn.GA2 oxidase_14 | SEQ ID NO: 558 | SEQ ID NO: 559 |
| Bn.GA2 oxidase_15 | SEQ ID NO: 560 | SEQ ID NO: 561 |

A family of at least seven GA2 oxidase genes have been identified in thale cress (*Arabidopsis thaliana*) including At.GA2 oxidase_1, At.GA2 oxidase_2, At.GA2 oxidase_3, At.GA2 oxidase_4, At.GA2 oxidase_6, and At.GA2 oxidase_7, and At.GA2 oxidase_8. The DNA and protein sequences by SEQ ID NO for each of these GA2 oxidase genes from *Arabidopsis* are provided in Table 12.

TABLE 12

DNA and protein sequences for GA2 oxidase genes in thale cress.

| GA2 oxidase Gene | Coding Sequence (CDS) | Protein |
|---|---|---|
| At.GA2 oxidase_1 | SEQ ID NO: 562 | SEQ ID NO: 563 |
| At.GA2 oxidase_2 | SEQ ID NO: 564 | SEQ ID NO: 565 |
| At.GA2 oxidase_3 | SEQ ID NO: 566 | SEQ ID NO: 567 |
| At.GA2 oxidase_4 | SEQ ID NO: 568 | SEQ ID NO: 569 |
| At.GA2 oxidase_6 | SEQ ID NO: 570 | SEQ ID NO: 571 |
| At.GA2 oxidase_7 | SEQ ID NO: 572 | SEQ ID NO: 573 |
| At.GA2 oxidase_8 | SEQ ID NO: 574 | SEQ ID NO: 575 |

A family of at least seven GA2 oxidase genes have been identified in moss (*Physcomitrella patens*) including Pp.GA2 oxidase_1, Pp.GA2 oxidase_2, Pp.GA2 oxidase_3, Pp.GA2 oxidase_4, Pp.GA2 oxidase_5, Pp.GA2 oxidase_6, and Pp.GA2 oxidase_7. The DNA and protein sequences by SEQ ID NO for each of these GA2 oxidase genes from moss are provided in Table 13.

TABLE 13

DNA and protein sequences for GA2 oxidase genes in moss.

| GA2 oxidase Gene | Coding Sequence (CDS) | Protein |
|---|---|---|
| Pp.GA2 oxidase_1 | SEQ ID NO: 576 | SEQ ID NO: 577 |
| Pp.GA2 oxidase_2 | SEQ ID NO: 578 | SEQ ID NO: 579 |
| Pp.GA2 oxidase_3 | SEQ ID NO: 580 | SEQ ID NO: 581 |
| Pp.GA2 oxidase_4 | SEQ ID NO: 582 | SEQ ID NO: 583 |
| Pp.GA2 oxidase_5 | SEQ ID NO: 584 | SEQ ID NO: 585 |
| Pp.GA2 oxidase_6 | SEQ ID NO: 586 | SEQ ID NO: 587 |
| Pp.GA2 oxidase_7 | SEQ ID NO: 588 | SEQ ID NO: 589 |

A family of at least nine GA2 oxidase genes have been identified in barrel clover (*Medicago truncatula*) including Mt.GA2 oxidase_1, Mt.GA2 oxidase_2, Mt.GA2 oxidase_3, Mt.GA2 oxidase_4, Mt.GA2 oxidase_5, Mt.GA2 oxidase_6, Mt.GA2 oxidase_7, Mt.GA2 oxidase_8, and Mt.GA2 oxidase_9. The DNA and protein sequences by SEQ ID NO for each of these GA2 oxidase genes from *Medicago* are provided in Table 14.

TABLE 14

DNA and protein sequences for GA2 oxidase genes in *M. truncatula*.

| GA2 oxidase Gene | Coding Sequence (CDS) | Protein |
|---|---|---|
| Mt.GA2 oxidase_1 | SEQ ID NO: 590 | SEQ ID NO: 591 |
| Mt.GA2 oxidase_2 | SEQ ID NO: 592 | SEQ ID NO: 593 |
| Mt.GA2 oxidase_3 | SEQ ID NO: 594 | SEQ ID NO: 595 |
| Mt.GA2 oxidase_4 | SEQ ID NO: 596 | SEQ ID NO: 597 |
| Mt.GA2 oxidase_5 | SEQ ID NO: 598 | SEQ ID NO: 599 |
| Mt.GA2 oxidase_6 | SEQ ID NO: 600 | SEQ ID NO: 601 |
| Mt.GA2 oxidase_7 | SEQ ID NO: 602 | SEQ ID NO: 603 |
| Mt.GA2 oxidase_8 | SEQ ID NO: 604 | SEQ ID NO: 605 |
| Mt.GA2 oxidase_9 | SEQ ID NO: 606 | SEQ ID NO: 607 |

A family of at least four related GA2 oxidase genes have been identified in whorled honey flower (*Paris polyphylla*) including Ppo.GA2 oxidase_1, Ppo.GA2 oxidase_2, Ppo.GA2 oxidase_3, and Ppo.GA2 oxidase_4. The DNA and protein sequences by SEQ ID NO for each of these GA2 oxidase genes from honey flower are provided in Table 15.

TABLE 15

DNA and protein sequences for GA2 oxidase genes in *P. polyphylla*.

| GA2 oxidase Gene | Coding Sequence (CDS) | Protein |
|---|---|---|
| Ppo.GA2 oxidase_1 | SEQ ID NO: 608 | SEQ ID NO: 609 |

TABLE 15-continued

| DNA and protein sequences for GA2 oxidase genes in *P. polyphylla.* | | |
|---|---|---|
| GA2 oxidase Gene | Coding Sequence (CDS) | Protein |
| Ppo.GA2 oxidase_2 | SEQ ID NO: 610 | SEQ ID NO: 611 |
| Ppo.GA2 oxidase_3 | SEQ ID NO: 612 | SEQ ID NO: 613 |
| Ppo.GA2 oxidase_4 | SEQ ID NO: 614 | SEQ ID NO: 615 |

A family of at least eight GA2 oxidase genes have been identified in common bean (*Phaseolus vulgaris*) including Pv.GA2 oxidase_1, Pv.GA2 oxidase_2, Pv.GA2 oxidase_3, Pv.GA2 oxidase_4, Pv.GA2 oxidase_5, Pv.GA2 oxidase_6, Pv.GA2 oxidase_7, and Pv.GA2 oxidase_8. The DNA and protein sequences by SEQ ID NO for each of these GA2 oxidase genes from common bean are provided in Table 16.

TABLE 16

| DNA and protein sequences for GA2 oxidase genes in common bean. | | |
|---|---|---|
| GA2 oxidase Gene | Coding Sequence (CDS) | Protein |
| Pv.GA2 oxidase_1 | SEQ ID NO: 616 | SEQ ID NO: 617 |
| Pv.GA2 oxidase_2 | SEQ ID NO: 618 | SEQ ID NO: 619 |
| Pv.GA2 oxidase_3 | SEQ ID NO: 620 | SEQ ID NO: 621 |
| Pv.GA2 oxidase_4 | SEQ ID NO: 622 | SEQ ID NO: 623 |
| Pv.GA2 oxidase_5 | SEQ ID NO: 624 | SEQ ID NO: 625 |
| Pv.GA2 oxidase_6 | SEQ ID NO: 626 | SEQ ID NO: 627 |
| Pv.GA2 oxidase_7 | SEQ ID NO: 628 | SEQ ID NO: 629 |
| Pv.GA2 oxidase_8 | SEQ ID NO: 630 | SEQ ID NO: 631 |

A family of at least seven related GA2 oxidase genes have been identified in cottonwood (*Populus trichocarpa*) including Pt.GA2 oxidase_1, Pt.GA2 oxidase_2, Pt.GA2 oxidase_3, Pt.GA2 oxidase_4, Pt.GA2 oxidase_5, Pt.GA2 oxidase_6, and Pt.GA2 oxidase_7. The DNA and protein sequences by SEQ ID NO for each of these GA2 oxidase genes from cottonwood are provided in Table 17.

TABLE 17

| DNA and protein sequences for GA2 oxidase genes in cottonwood. | | |
|---|---|---|
| GA2 oxidase Gene | Coding Sequence (CDS) | Protein |
| Pt.GA2 oxidase_1 | SEQ ID NO: 632 | SEQ ID NO: 633 |
| Pt.GA2 oxidase_2 | SEQ ID NO: 634 | SEQ ID NO: 635 |
| Pt.GA2 oxidase_3 | SEQ ID NO: 636 | SEQ ID NO: 637 |
| Pt.GA2 oxidase_4 | SEQ ID NO: 638 | SEQ ID NO: 639 |
| Pt.GA2 oxidase_5 | SEQ ID NO: 640 | SEQ ID NO: 641 |
| Pt.GA2 oxidase_6 | SEQ ID NO: 642 | SEQ ID NO: 643 |
| Pt.GA2 oxidase_7 | SEQ ID NO: 644 | SEQ ID NO: 645 |

A family of at least two GA2 oxidase genes have been identified in pea (*Pisum sativum*) including Ps.GA2 oxidase_1 and Ps.GA2 oxidase_2. The DNA and protein sequences by SEQ ID NO for these GA2 oxidase genes from pea are provided in Table 18.

TABLE 18

| DNA and protein sequences for GA2 oxidase genes in pea. | | |
|---|---|---|
| GA2 oxidase Gene | Coding Sequence (CDS) | Protein |
| Ps.GA2 oxidase_1 | SEQ ID NO: 646 | SEQ ID NO: 647 |
| Ps.GA2 oxidase_2 | SEQ ID NO: 648 | SEQ ID NO: 649 |

A family of at least three related GA2 oxidase genes have been identified in spinach (*Spinacia oleracea*) including So.GA2 oxidase_1, So.GA2 oxidase_2, and So.GA2 oxidase_3. The DNA and protein sequences by SEQ ID NO for each of these GA2 oxidase genes from spinach are provided in Table 19.

TABLE 19

| DNA and protein sequences for GA2 oxidase genes in spinach. | | |
|---|---|---|
| GA2 oxidase Gene | Coding Sequence (CDS) | Protein |
| So.GA2 oxidase_1 | SEQ ID NO: 650 | SEQ ID NO: 651 |
| So.GA2 oxidase_2 | SEQ ID NO: 652 | SEQ ID NO: 653 |
| So.GA2 oxidase_3 | SEQ ID NO: 654 | SEQ ID NO: 655 |

According to some embodiments, a GA2 oxidase protein encoded by a transcribable DNA sequence of a recombinant DNA construct is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 325, 327, 329, 331, 333, 335, 337, 339, 341, 343, 345, 347, and/or 349. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 324, 326, 328, 330, 332, 334, 336, 338, 340, 342, 344, 346, and/or 348.

According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 351, 353, 355, 357, 359, 361, 363, 365, 367 and/or 397. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 350, 352, 354, 356, 358, 360, 362, 364, 366 and/or 368. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 371, 373, 375, 377, 379, 381, 383 and/or 385. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 370, 372, 374, 376, 378, 380, 382 and/or 384. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 387, 389, 391, 393, 395, 397, 399, 401, 403, 405, 407, 409, 411, 413, 415 and/or 417. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 386, 388, 390, 392, 394, 396, 398, 400, 402, 404, 406, 408, 410, 412, 414 and/or 416. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 419, 421, 423, 425, 427, 429, 431, 433, 435, 437, 439, 441, 443, 445 and/or 447. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 418, 420, 422, 424, 426, 428, 430, 432, 434, 436, 438, 440, 442, 444 and/or 446. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 449, 451, 453, 455, 457, 459, 461, 463, 465, 467 and/or 469. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 448, 450, 452, 454, 456, 458, 460, 462, 464, 466 and/or 468.

According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to a protein sequence from a dicot or leguminous plant. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 471, 473, 475, 477, 479, 481, 483, 485, 487, 489, 491, 493, 495, 497, 499 and/or 501. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 470, 472, 474, 476, 478, 480, 482, 484, 486, 488, 490, 492, 494, 496, 498 and/or 500. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 503, 505, 507, 509, 511, 513, 515, 517, 519, 521, 523, 525, 527, 529 and/or 531. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 502, 504, 506, 508, 510, 512, 514, 516, 518, 520, 522, 524, 526, 528 and/or 530. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 533, 535, 537, 539, 541, 543, 545, 547, 549, 551, 553, 555, 557, 559 and/or 561. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 532, 534, 536, 538, 540, 542, 544, 546, 548, 550, 552, 554, 556, 558 and/or 560. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 563, 565, 567, 569, 571, 573 and/or 575. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 562, 564, 566, 568, 570, 572 and/or 574. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 577, 579, 581, 583, 585, 587 and/or 589. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 576, 578, 580, 582, 584, 586 and/or 588. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 591, 593, 595, 597, 599, 601, 603, 605 and/or 607. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 590, 592, 594, 596, 598, 600, 602, 604 and/or 606. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 609, 611, 613 and/or 615. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 608, 610, 612 and/or 614. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 617, 619, 621, 623, 625, 627, 629 and/or 631. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 616, 618, 620, 622, 624, 626, 628 and/or 630. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 633, 635, 637, 639, 641, 643 and/or 645. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 632, 634, 636, 638, 640, 642 and/or 644. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 647 and/or 649. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 646 and/or 648. According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 651, 653 and/or 655. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 650, 652 and/or 654.

According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467 and/or 469. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466 and/or 468.

According to some embodiments, a GA2 oxidase protein encoded by a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653 and/or 655. According to some embodiments, a transcribable DNA sequence of a recombinant DNA molecule, vector or construct is or comprises a sequence that is at least 80%, at least 85%, at least 90%, at least 95%, at least 96%, at least 97%, at least 98%, at least 99%, at least 99.5%, or 100% identical to one or more of SEQ ID NOs: 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652 and/or 654.

According to embodiments of the present invention, the level(s) of one or more active GAs may be reduced in the stalk or stem of a corn plant by ectopically expressing a catabolic GA2 oxidase gene to produce the short stature phenotype and resistance to lodging in transgenic plants, but without off-types in the reproductive or ear tissues of the plant.

According to embodiments of the present invention, expression of a GA2 oxidase transgene may be driven by a variety of different plant-expressible promoter types including constitutive and tissue-specific or tissue-preferred promoters, such as a vascular or leaf promoter. According to present embodiments, a recombinant DNA molecule, vector or construct for expression of a GA2 oxidase transgene in a plant is provided comprising a transcribable DNA sequence encoding a protein that is at least 80%, at least 85%, at least 90%, at least 95%, at least 96%, at least 97%, at least 98%, at least 99%, at least 99.5%, or 100% identical to a GA2 oxidase protein sequence provided herein, wherein the transcribable DNA sequence is operably linked to a plant-expressible promoter, such as a constitutive, vascular or leaf promoter. According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 325, 327, 329, 331, 333, 335, 337, 339, 341, 343, 345, 347 and/or 349, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 324, 326, 328, 330, 332, 334, 336, 338, 340, 342, 344, 346, and/or 348. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 324, 326, 328, 330, 332, 334, 336, 338, 340, 342, 344, 346, and/or 348, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 351, 353, 355, 357, 359, 361, 363, 365, 367 and/or 369, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 350, 352, 354, 356, 358, 360, 362, 364, 366 and/or 368. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 350, 352, 354, 356, 358, 360, 362, 364, 366 and/or 368, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 371, 373, 375, 377, 379, 381, 383, and/or 385, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 370, 372, 374, 376, 378, 380, 382, and/or 384. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 370, 372, 374, 376, 378, 380, 382, and/or 384, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 387, 389, 391, 393, 395, 397, 399, 401, 403, 405, 407, 409, 411, 413, 415, and/or 417, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 386, 388, 390, 392, 394, 396, 398, 400, 402, 404, 406, 408, 410, 412, 414, and/or 416. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 386, 388, 390, 392, 394, 396, 398, 400, 402, 404, 406, 408, 410, 412, 414, and/or 416, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 419, 421, 423, 425, 427, 429, 431, 433, 435, 437, 439, 441, 443, 445, and/or 447, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 418, 420, 421, 424, 426, 428, 430, 432, 434, 436, 438, 440, 442, 444, and/or 446. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 418, 420, 421, 424, 426, 428, 430, 432, 434, 436, 438, 440, 442, 444, and/or 446, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 449, 451, 453, 455, 457, 459, 461, 463, 465, 467, and/or 469, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 448, 450, 452, 454, 456, 458, 460, 462, 464, 466, and/or 468. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 448, 450, 452, 454, 456, 458, 460, 462, 464, 466, and/or 468, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 471, 473, 475, 477, 479, 481, 483, 485, 487, 489, 491, 493, 495, 497, 499, and/or 501, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 470, 472, 474, 476, 478, 480, 482, 484, 486, 488, 490, 492, 494, 496, 498, and/or 500. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 470, 472, 474, 476, 478, 480, 482, 484, 486, 488, 490, 492, 494, 496, 498, and/or 500, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 503, 505, 507, 509, 511, 513, 515, 517, 519, 521, 523, 525, 527, 529, and/or 531, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 502, 504, 506, 508, 510, 512, 514, 516, 518, 520, 522, 524, 526, 528, and/or 530. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 502, 504, 506, 508, 510, 512, 514, 516, 518, 520, 522, 524, 526, 528, and/or 530, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 533, 535, 537, 539, 541, 543, 545, 547, 549, 551, 553, 555, 557, 559, and/or 561, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 532, 534, 536, 538, 540, 542, 544, 546, 548, 550, 552, 554, 556, 558, and/or 560. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 532, 534, 536, 538, 540, 542, 544, 546, 548, 550, 552, 554, 556, 558, and/or 560, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 563, 565, 567, 569, 571, 573, and/or 575, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 562, 564, 566, 568, 570, 572, and/or 574. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 562, 564, 566, 568, 570, 572, and/or 574, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 577, 579, 581, 583, 585, 587, and/or 589, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 576, 578, 580, 582, 584, 586, and/or 588. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 576, 578, 580, 582, 584, 586, and/or 588, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 591, 593, 595, 597, 599, 601, 603, 605, and/or 607, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 590, 592, 594, 596, 598, 600, 602, 604, and/or 608. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 590, 592, 594, 596, 598, 600, 602, 604, and/or 608, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 609, 611, 613, and/or 615, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 608, 610, 612, and/or 614. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 608, 610, 612, and/or 614, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least \75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 617, 619, 621, 623, 625, 627, 629, and/or 631, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 616, 618, 620, 622, 624, 626, 628, and/or 630. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 616, 618, 620, 622, 624, 626, 628, and/or 630, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least \75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 633, 635, 637, 639, 641, 643, and/or 645, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 632, 634, 636, 638, 640, 642, and/or 644. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 632, 634, 636, 638, 640, 642, and/or 644, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least \75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 647 and/or 649, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 646 and/or 648. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 646 and/or 648, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least \75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence encoding a GA2 oxidase protein that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 651, 653, and/or 655, wherein the transcribable DNA sequence is operably linked to a plant-expressible promoter. According to some of these embodiments, the transcribable DNA sequence of the recombinant DNA molecule, vector or construct comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 650, 652, and/or 654. According to some embodiments, the plant expressible promoter is a vascular promoter. According to some embodiments, the plant expressible promoter is a vascular promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to some embodiments, a recombinant DNA molecule, vector or construct is provided comprising a transcribable DNA sequence that comprises or consists of a sequence that is at least 80%, at least 85%, at least 90%, at least 95%, at least 96%, at least 97%, at least 98%, at least 99%, at least 99.5%, or 100% identical to one or more of SEQ ID NOs: 650, 652, and/or 654, wherein the transcribable DNA sequence is operably linked to a plant-expressible promoter. According to some embodiments, the transcribable DNA sequence encodes a GA2 oxidase protein. According to some embodiments, the plant expressible promoter is a vascular promoter. According to some embodiments, the plant expressible promoter is a vascular promoter comprising a sequence that is at least 70%, at least \75%, at least 80%, at least 85%, at least 90%, at least 95%, at least 96%, at least 97%, at least 98%, at least 99%, at least 99.5%, or 100% identical to one or more of SEQ ID NOs: 656, 657, 658, 659, 660, 661, and/or 662, or a functional portion of any of the foregoing. According to some embodiments, the plant expressible promoter is a RTBV promoter (e.g., a promoter comprising the RTBV (SEQ ID NO: 656) or truncated RTBV (SEQ ID NO: 657) sequence) or a promoter comprising a sequence that is at least 70%, at least 75%, at least 80%, at least 85%, at least 90%, at least 95%, at least 96%, at least 97%, at least 98%, at least 99%, at least 99.5%, or 100% identical to SEQ ID NO: 656 and/or 657. According to some embodiments, the plant expressible promoter is a leaf promoter. According to some embodiments, the plant expressible promoter is a leaf promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 663, 664, and/or 665, or a functional portion of any of the foregoing. According to some embodiments, the plant expressible promoter is a constitutive promoter. According to some embodiments, the plant expressible promoter is a constitutive promoter comprising a sequence that is at least 70%, at least 75%, at least 80%, at least 85%, at least 90%, at least 95%, at least 96%, at least 97%, at least 98%, at least 99%, at least 99.5%, or 100% identical to one or more of SEQ ID NOs: 666, 667, 668, 669, 670, 671, 672, 673, and/or 674, or a functional portion of any of the foregoing.

According to many embodiments, a modified or transgenic corn plant is provided comprising and/or transformed with a recombinant DNA construct comprising a transcribable DNA sequence encoding a GA2 oxidase protein as provided herein. According to some embodiments, a modified or transgenic corn plant is provided that is transformed with a recombinant DNA construct comprising a transcribable DNA sequence encoding a GA2 oxidase mRNA and protein, wherein the transcribable DNA sequence is operably linked to a plant-expressible promoter, wherein the GA2 oxidase mRNA and/or protein is identical to an endogenous GA2 oxidase protein, and wherein the expression level of the GA2 oxidase mRNA and/or protein is increased in one or more plant tissue(s) of the modified or transgenic plant as compared to a wild type or control plant, such as increased in one or more vascular and/or leaf tissue(s) of the modified or transgenic plant, such as by at least 5%, at least 10%, at least 20%, at least 25%, at least 30%, at least 40%, at least 50%, at least 60%, at least 70%, at least 75%, at least 80%, at least 90%, or 100%, as compared to a wild type or control plant.

According to present embodiments, a modified or transgenic corn plant is provided comprising a recombinant DNA construct comprising a transcribable DNA sequence encoding a GA2 oxidase protein as provided herein, wherein the level of one or more active GAs, such as GA1, GA3, GA4, and/or GA7, is reduced or lowered in one or more plant tissue(s), such as one or more stem, internode, vascular and/or leaf tissue(s) or one or more stem and/or internode tissue(s), of the modified or transgenic plant, such as by at least 5%, at least 10%, at least 20%, at least 25%, at least 30%, at least 40%, at least 50%, at least 60%, at least 70%, at least 75%, at least 80%, at least 90%, or 100%, as compared to a wild type or control plant.

According to many embodiments, a modified or transgenic plant is provided that is transformed with a recombinant DNA construct comprising a transcribable DNA sequence encoding a GA2 oxidase protein as provided herein, wherein the transcribable DNA sequence is operably linked to a constitutive promoter or a tissue-specific or tissue-preferred promoter, such as a vascular promoter or a leaf promoter, and wherein the modified or transgenic plant has one or more of the following traits: a semi-dwarf or reduced plant height or stature, decreased stem internode length, increased lodging resistance, and/or increased stem or stalk diameter. Such a modified or transgenic plant may not have any significant reproductive off-types. A modified or transgenic plant may have one or more of the following additional traits: reduced green snap, deeper roots, increased leaf area, earlier canopy closure, higher stomatal conductance, lower ear height, increased foliar water content, improved drought tolerance, increased nitrogen use efficiency, increased water use efficiency, reduced anthocyanin content and anthocyanin area in leaves under normal and/or nitrogen or water limiting stress conditions, increased ear weight, increased kernel number, increased kernel weight, increased yield, and/or increased harvest index. According to many embodiments, the level of one or more active GAs, such as GA1, GA3, GA4, and/or GA7, is/are reduced or lowered in one or more plant tissue(s), such as one or more stem, internode, vascular and/or leaf tissue(s), or one or more stem and/or internode tissue(s), of the modified or transgenic plant, such as by at least 5%, at least 10%, at least 20%, at least 25%, at least 30%, at least 40%, at least 50%, at least 60%, at least 70%, at least 75%, at least 80%, at least 90%, or 100%, as compared to a wild type or control plant.

A recombinant DNA molecule, construct or vector of the present disclosure may comprise a transcribable DNA sequence encoding a GA2 oxidase as provided herein, wherein the transcribable DNA sequence is operatively linked to a plant-expressible promoter, such as a constitutive or vascular and/or leaf promoter. In addition to its associated promoter, a transcribable DNA sequence encoding a GA2 oxidase may also be operatively linked to one or more additional regulatory element(s), such as an enhancer(s), leader, transcription start site (TSS), linker, 5' and 3' untranslated region(s) (UTRs), intron(s), polyadenylation signal, termination region or sequence, etc., that are suitable, necessary or preferred for strengthening, regulating or allowing expression of the transcribable DNA sequence in a corn plant cell. Such additional regulatory element(s) may be optional and/or used to enhance or optimize expression of the transgene or transcribable DNA sequence. As provided herein, an "enhancer" may be distinguished from a "promoter" in that an enhancer typically lacks a transcription start site, TATA box, or equivalent sequence and is thus insufficient alone to drive transcription. As used herein, a "leader" may be defined generally as the DNA sequence of the 5'-UTR of a gene (or transgene) between the transcription start site (TSS) and 5' end of the transcribable DNA sequence or protein coding sequence start site of the transgene.

Transgenic plants expressing a GA2 oxidase transgene may have an earlier canopy closure (e.g., approximately one day earlier, or 12-48 hours, 12-36 hours, 18-36 hours, or about 24 hours earlier canopy closure) than a wild type or control plant. Although transgenic plants expressing a GA2 oxidase transgene may have a lower ear height than a wild type or control plant, the height of the ear may generally be at least 18 inches above the ground. Transgenic plants expressing a GA2 oxidase may have greater biomass and/or leaf area during one or more late vegetative stages (e.g., V8-V12) than a wild type or control plant. Transgenic plants expressing a GA2 oxidase may have deeper roots during later vegetative stages when grown in the field, than a wild type or control plant, which may be due to an increased root front velocity. These transgenic plants may reach a depth 90 cm below ground sooner (e.g., 5-25 days sooner, 5-20 days sooner, 5-15 days sooner, 10-25 days sooner, or 15-25 days sooner, or about 5, 10, 15, 20 Or 25 days sooner) than a wild type or control plant, which may occur by or prior to the vegetative to reproductive transition of the plant (e.g., by V16/R1 at about 50 days after planting as opposed to about 70 days after planting for control plants).

According to some embodiments, a recombinant DNA construct or vector may comprise two or more expression elements or cassettes that may be stacked together in a construct or vector either in tandem in a single expression cassette or separately in two or more expression cassettes. A recombinant DNA construct or vector may comprise either a single expression cassette comprising a transcribable DNA sequence that encodes a GA2 oxidase mRNA and protein or two or more expression cassettes comprising two or more transcribable DNA sequences that encode two or more GA2 oxidase mRNAs and proteins, including at least a first GA2 oxidase mRNA and protein and a second GA2 oxidase mRNA and protein, wherein the two or more transcribable DNA sequences, GA2 oxidase mRNAs and/or GA2 oxidase proteins are the same or different, and wherein each transcribable DNA sequence is operably linked to a plant-expressible promoter. The plant-expressible promoter may be a constitutive promoter, or a tissue-specific or tissue-preferred promoter, as provided herein. If two or more transcribable DNA sequences are present in a recombinant DNA construct or vector or a modified or transgenic plant, plant part, cell, or explant, each transcribable DNA sequence may be operably linked to the same or different plant-expressible promoters.

According to other embodiments, a recombinant DNA construct or vector may comprise two or more expression cassettes including a first expression cassette and a second expression cassette, wherein the first expression cassette comprises a first transcribable DNA sequence operably linked to a first plant-expressible promoter, and the second expression cassette comprises a second transcribable DNA sequence operably linked to a second plant-expressible promoter, wherein the first transcribable DNA sequence encodes a first GA2 oxidase and the second transcribable DNA sequence encodes a second GA2 oxidase. The first and second plant-expressible promoters may each be a constitutive promoter, or a tissue-specific or tissue-preferred promoter, as provided herein, and the first and second plant-expressible promoters may be the same or different promoters.

According to other embodiments, two or more constructs, expression cassettes or transgenes encoding one or more GA2 oxidase proteins may be combined in a modified plant by crossing two or more plants together in one or more generations to produce a modified plant having a desired combination of the constructs, expression cassettes or transgenes. According to these embodiments, a first modified plant comprising a first construct, expression cassette or transgene encoding a first GA2 oxidase protein may be crossed to a second modified plant comprising a second construct, expression cassette or transgene encoding a second GA2 oxidase protein, such that a modified progeny plant may be made comprising the first construct, expression cassette or transgene and the second construct, expression cassette or transgene. Alternatively, a modified plant comprising two or more constructs, expression cassettes or transgenes encoding two or more GA2 oxidase proteins may be made by (i) co-transforming a first construct, expression cassette or transgene and a second construct, expression cassette or transgene (each encoding a GA2 oxidase protein)

in the same or different transformation molecules or vectors, (ii) transforming a modified plant with a second construct, expression cassette or transgene in a transformation molecule or vector, wherein the modified plant already comprises a first construct, expression cassette or transgene, or (iii) transforming a plant with a first construct, expression cassette or transgene in a first transformation molecule or vector, and then transforming the plant with a second construct, expression cassette or transgene in a second transformation molecule or vector.

According to embodiments of the present disclosure, modified plants are provided comprising two or more constructs comprising GA2 oxidase transgene(s) including a first recombinant DNA construct and a second recombinant DNA construct, wherein the first recombinant DNA construct comprises a first transcribable DNA sequence encoding a first GA2 oxidase mRNA and protein, and the second recombinant DNA construct comprises a second transcribable DNA sequence encoding a second GA2 oxidase mRNA and protein. The first and second recombinant DNA constructs may be stacked in a single vector and transformed into a plant as a single event, or present in separate vectors or constructs that may be transformed as separate events. According to some embodiments, the first and second GA2 oxidase transgenes may be the same or different GA oxidase gene(s).

In an aspect, at least 10% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, at least 20% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, at least 30% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, at least 40% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, at least 50% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, at least 60% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, at least 70% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, at least 80% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, at least 90% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, 100% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter.

In an aspect, between 1% and 100% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, between 10% and 100% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, between 20% and 100% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, between 30% and 100% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, between 40% and 100% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, between 50% and 100% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, between 60% and 100% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, between 70% and 100% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, between 80% and 100% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter. In an aspect, between 90% and 100% of the corn plants in a field comprise a recombinant DNA construct comprising a transcribable DNA sequence encoding a GA2 oxidase protein and a plant-expressible promoter, wherein the transcribable DNA sequence is operably linked to the plant-expressible promoter.

In an aspect, any method provided herein that produces at least one hybrid corn seed further comprises selecting at least one harvested hybrid corn seed, where the at least one hybrid corn seed comprises a mutant allele. In an aspect, a selecting step comprises selecting at least one hybrid corn seed that is homozygous or biallelic for a transgene or mutant allele. In an aspect, a selecting step comprises selecting a plurality of corn seeds that are homozygous or biallelic for a transgene or mutant allele. In an aspect, a selecting step comprises selecting at least one hybrid corn seed that is heterozygous or hemizygous for the transgene or mutant allele. In an aspect, a selecting step comprises selecting a plurality of hybrid corn seeds that are heterozygous or hemizygous for the transgene or mutant allele.

The screening and selection of modified, engineered, or transgenic plants or plant cells can be through any methodologies (e.g., molecular techniques) known to those having ordinary skill in the art. Examples of screening and selection methodologies include, but are not limited to, Southern analysis, PCR amplification for detection of a polynucleotide, Northern blots, RNase protection, primer-extension, RT-PCR amplification for detecting RNA transcripts, Sanger sequencing, Next Generation sequencing technologies (e.g., Illumina, PacBio, Ion Torrent, 454) enzymatic assays for detecting enzyme or ribozyme activity of polypeptides and polynucleotides, and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known.

In an aspect, a method provided herein comprises selecting or sorting progeny seeds or plants based on a screenable phenotype. In an aspect, a method provided herein comprises selecting or sorting progeny seeds or plants based on a selectable phenotype. In an aspect, a method provided herein comprises selecting or sorting progeny seeds or plants based on a molecular genotype. Selecting or sorting progeny seeds or plants based on the presence or absence of a selectable or screenable marker or molecular genotype depending on the presence and zygosity of the selectable or screenable marker or molecular genotype in the female or male parent plants for the seed production cross.

As used herein, a "screenable" or "selectable" phenotype refers to phenotypes that can be distinguished visually, chemically, or molecularly that facilitates identification of desired progeny seeds or plants. Non-limiting examples of molecular techniques suitable for screening or selection are described above. In an aspect, a progeny seed or plant comprises a selectable marker. Non-limiting examples of selectable markers include those that confer resistance to toxic chemicals (e.g., antibiotics), or impart a visually distinguishing characteristic (e.g., seed color, embryo color, aleurone color, fluorescence, shrunken kernels). Useful plant selectable marker genes include, but are not limited to, genes encoding antibiotic resistance genes (e.g., resistance to hygromycin, imidazolinone, kanamycin, bleomycin, G418, streptomycin, spectinomycin), and herbicide resistance genes (e.g., phosphinothricin acetyltransferase, modified ALS, BAR, modified class I EPSPSs, class II EPSPSs, DMOs).

Without being limiting, a screenable or selectable marker may include one or more of a number of genes can result in a visible seed or plant phenotype, including β-glucuronidase (GUS), green fluorescence protein (GFP), luciferase, sacB (a levansucrase gene that can cause a shrunken seed phenotype), pyrophosphatase gene (which can inhibit germination), phytoene synthase (crtB, which can cause an orange coloration), an R-locus gene (which encodes a product that regulates the production of anthocyanin pigments (red color), β-lactamase, xylE, α-amylase, a tyrosinase gene (which encodes an enzyme capable of oxidizing tyrosine to DOPA and dopaquinone that in turn condenses to melanin), and α-galactosidase. Additional selectable marker genes include plant hormone biosynthetic pathway genes (e.g., a GA pathway gene, a cytokinin pathway gene (e.g., isopentenyl transferase), an auxin pathway gene (e.g., an IAA synthase gene), an ethylene pathway gene (e.g., an ACC synthase), an abcisic acid pathway gene), plant hormone degradative genes (e.g., GA2 oxidase, ACC deaminase), plant hormone biosynthetic pathway substrate-diverting genes (e.g., phytoene synthase, GA20 oxidase, GA 2β,3β-hydroxylase), plant hormone signaling genes, and metabolic interference genes (e.g., sacB, Suc2, TPS1. See, e.g., WO 2004/092390 and WO 2007/134234, both of which are incorporated herein by reference in their entireties, for additional information regarding selectable and/or screenable marker genes.

In an aspect, progeny seeds are selected or sorted on the basis of a presence or absence of a screenable or selectable marker. In an aspect, progeny seeds are selected or sorted on the basis of a seed color. In an aspect, progeny seeds are selected or sorted on the basis of a seed phenotype. In an aspect, progeny seeds or plants are selected or sorted on the basis of a genotype. In an aspect, progeny seeds or plants are selected on the basis of a resistance or susceptibility to one or more antibiotics. In an aspect, progeny seeds or plants are selected on the basis of a resistance or susceptibility to one or more herbicides. In an aspect, progeny seeds or plants are selected or sorted on the basis of a fluorescent or color molecule or compound.

In an aspect, selecting is performed following genotyping seeds using a molecular or biochemical technique. In an aspect, selecting is performed following phenotypic analysis. In an aspect, selecting is performed following germination of the seeds. In an aspect, selecting is performed after determining the zygosity of the seed. In an aspect, selecting comprises a visual assay of the seed. In an aspect, selecting comprises separating seeds. In an aspect, selecting comprises placing selected seeds in a container or packet.

Without being limiting, this disclosure provides several methods related to the production of hybrid corn seeds.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_3 locus, wherein the mutant allele comprises a DNA segment inserted into the endogenous GA20 oxidase_3 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_3 locus produces a RNA transcript comprising the antisense RNA sequence; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a DNA segment inserted into the endogenous GA20 oxidase_5 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_5 locus produces a RNA transcript comprising the antisense RNA sequence; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of an endogenous Brachytic2 (br2) locus, wherein the mutant allele comprises a DNA segment inserted into the endogenous br2 locus, wherein the DNA segment encodes an antisense RNA that is at least 70% complementary to at least 20 consecutive nucleotides of SEQ ID NO: 132 or 180, and wherein the mutant allele of the endogenous br2 locus produces an RNA transcript comprising the antisense RNA sequence; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of an endogenous Brachytic2 (br2) locus, wherein the mutant allele comprises a deletion of at least one nucleotide of an endogenous br2 locus as compared to SEQ ID NO: 132; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a premature stop codon within a nucleic acid sequence encoding a Brachytic2 protein as compared to a control corn plant; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants comprise a short stature phenotype exhibited by an average height that is at least 2.5% lower than the average height of the at least one male inbred corn plant, wherein the female inbred corn plants comprise a dominant or semi-dominant transgene or mutant allele of a gene, and wherein the transgene or mutant allele causes the short stature phenotype of the female inbred corn plants; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a recombinant DNA construct comprising a transcribable DNA sequence encoding a GA2 oxidase protein and a plant-expressible promoter, wherein the transcribable DNA sequence is operably linked to the plant-expressible promoter; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_3 locus, wherein the mutant allele comprises a DNA segment inserted into the endogenous GA20 oxidase_3 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_3 locus produces a RNA transcript comprising the antisense RNA sequence; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a DNA segment inserted into the endogenous GA20 oxidase_5 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_5 locus produces a RNA transcript comprising the antisense RNA sequence; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of an endogenous Brachytic2 (br2) locus, wherein the mutant allele comprises a DNA segment inserted into the endogenous br2 locus, wherein the DNA segment encodes an antisense RNA that is at least 70% complementary to at least 20 consecutive nucleotides of SEQ ID NO: 132 or 180, and wherein the mutant allele of the endogenous br2 locus produces an RNA transcript comprising the antisense RNA sequence; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of an endogenous Brachytic2 (br2) locus, wherein the mutant allele comprises a deletion of at least one nucleotide of an endogenous br2 locus as compared to SEQ ID NO: 132; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a premature stop codon within a nucleic acid sequence encoding a Brachytic2 protein as compared to a control corn plant; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants comprise a short stature phenotype exhibited by an average height that is at least 2.5% lower than the average height of the at least one male inbred corn plant, wherein the plurality of female inbred corn plants comprise a dominant or semi-dominant transgene or mutant allele of a gene, and wherein the transgene or mutant allele causes the short stature phenotype of the plurality of female inbred corn plants; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a recombinant DNA construct comprising a transcribable DNA sequence encoding a GA2 oxidase protein and a plant-expressible promoter, wherein the transcribable DNA sequence is operably linked to the plant-expressible promoter; and (b) harvesting said hybrid corn seeds from one or more of the female inbred corn plants In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_3 locus, wherein the mutant allele comprises a DNA segment inserted into the endogenous GA20 oxidase_3 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_3 locus produces a RNA transcript comprising the antisense RNA sequence; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a DNA segment inserted into the endogenous GA20 oxidase_5 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_5 locus produces a RNA transcript comprising the antisense RNA sequence; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of an endogenous Brachytic2 (br2) locus, wherein the mutant allele comprises a DNA segment inserted into the endogenous br2 locus, wherein the DNA segment encodes an antisense RNA that is at least 70% complementary to at least 20 consecutive nucleotides of SEQ ID NO: 132 or 180, and wherein the mutant allele of the endogenous br2 locus produces an RNA transcript comprising the antisense RNA sequence; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of an endogenous Brachytic2 (br2) locus, wherein the mutant allele comprises a deletion of at least one nucleotide of an endogenous br2 locus as compared to SEQ ID NO: 132; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a premature stop codon within a nucleic acid sequence encoding a Brachytic2 protein as compared to a control corn plant; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants comprise a short stature phenotype exhibited by an average height that is at least 2.5% lower than the average height of the at least one male inbred corn plant, wherein the female inbred corn plants comprise a dominant or semi-dominant transgene or mutant allele of a gene, and wherein the transgene or mutant allele causes the short stature phenotype of the female inbred corn plants; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a recombinant DNA construct comprising a transcribable DNA sequence encoding a GA2 oxidase protein and a plant-expressible promoter, wherein the transcribable DNA sequence is operably linked to the plant-expressible promoter; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genome modification comprising a deletion of at least a portion of the transcription termination sequence of the endogenous Zm.SAMT gene, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genome modification comprising a deletion of at least a portion of the intergenic region between the endogenous GA20 oxidase_5 and Zm.SAMT genes, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genome modification comprising a deletion of at least a portion of one or more of the following: 5' UTR, 1st exon, 1st intron, 2nd exon, 2nd intron, 3rd exon, 3' UTR, and any portion thereof, and the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any portion thereof, of the endogenous Zm.SAMT gene; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genome modification which results in the transcription of an antisense strand of at least an exon, an intron, or an untranslated region (UTR) of the endogenous GA20 oxidase_5 gene, or any portion thereof; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises the Zm.SAMT gene promoter, or a functional part thereof, operably linked to at least one transcribable antisense sequence of at least an exon, intron or untranslated region (UTR) of the endogenous GA20 oxidase_5 gene, or any portion thereof; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a sequence selected from the group consisting of SEQ ID NOs: 304-322; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a first sequence and a second sequence; wherein the first sequence comprises one or more of the 5' UTR, 1st exon, 1st intron, 2nd exon, 2nd intron, 3rd exon, 3' UTR, and any complementary sequence thereof, and any portion of the foregoing, of the endogenous Zm.GA20 oxidase_5 gene; and wherein the second sequence comprises one or more of the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any complementary sequence thereof, and any portion of the foregoing, of the endogenous Zm.SAMT gene; wherein the first sequence and the second sequence are contiguous or separated only by an intervening sequence of fewer than 555 nucleotides; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genomic deletion relative to a wild type allele of the endogenous GA20 oxidase_5 locus, wherein the genomic deletion is flanked by a first sequence and a second sequence; wherein the first sequence comprises one or more of the 5' UTR, 1st exon, 1st intron, 2nd exon, 2nd intron, 3rd exon, 3' UTR, and any complementary sequence thereof, and any portion of the foregoing, of the endogenous Zm.GA20 oxidase_5 gene; and wherein the second sequence comprises one or more of the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any complementary sequence thereof, and any portion of the foregoing, of the endogenous Zm.SAMT gene; and (b) harvesting said hybrid corn seeds from one or more of the female inbred corn plants.

In an aspect, this disclosure provides a method comprising: (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genomic sequence comprising a first sequence and a second sequence; wherein the first sequence comprises at least 15 consecutive nucleotides of one or more of SEQ ID NOs: 228-235 and 276-283; wherein the second sequence comprises at least 15 consecutive nucleotides of one or more of SEQ ID NOs: 235-276; and wherein the genomic sequence is at least 50 consecutive nucleotides in length, and/or fewer than 9000 consecutive nucleotides in length; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of the transcription termination sequence of the endogenous Zm.SAMT gene, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of the intergenic region between the endogenous GA20 oxidase_5 and Zm.SAMT genes, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of one or more of the following: 5' UTR, 1st exon, 1st intron, 2nd exon, 2nd intron, 3rd exon, 3' UTR, and any portion thereof, and the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any portion thereof, of the endogenous Zm.SAMT gene; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification which results in the transcription of an antisense strand of at least an exon, an intron, or an untranslated region (UTR) of the endogenous GA20 oxidase_5 gene, or any portion thereof; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises the Zm.SAMT gene promoter, or a functional part thereof, operably linked to at least one transcribable antisense sequence of at least an exon, intron or untranslated region (UTR) of the endogenous GA20 oxidase_5 gene, or any portion thereof; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a sequence selected from the group consisting of SEQ ID NOs: 304-322; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a first sequence and a second sequence; wherein the first sequence comprises one or more of the 5' UTR, 1st exon, 1st intron, 2nd exon, 2nd intron, 3rd exon, 3' UTR, and any complementary sequence thereof, and any portion of the foregoing, of the endogenous Zm.GA20 oxidase_5 gene; and wherein the second sequence comprises one or more of the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any complementary sequence thereof, and any portion of the foregoing, of the endogenous Zm.SAMT gene; wherein the first sequence and the second sequence are contiguous or separated only by an intervening sequence of fewer than 555 nucleotides; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic deletion relative to a wild type allele of the endogenous GA20 oxidase_5 locus, wherein the genomic deletion is flanked by a first sequence and a second sequence; wherein the first sequence comprises one or more of the 5' UTR, 1st exon, 1st intron, 2nd exon, 2nd intron, 3rd exon, 3' UTR, and any complementary sequence thereof, and any portion of the foregoing, of the endogenous Zm.GA20 oxidase_5 gene; and wherein the second sequence comprises one or more of the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any complementary sequence thereof, and any portion of the foregoing, of the endogenous Zm.SAMT gene; and (b) harvesting said hybrid corn seeds from one or more of the female inbred corn plants.

In an aspect, this disclosure provides a method comprising: (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic sequence comprising a first sequence and a second sequence; wherein the first sequence comprises at least 15 consecutive nucleotides of one or more of SEQ ID NOs: 228-235 and 276-283; wherein the second sequence comprises at least 15 consecutive nucleotides of one or more of SEQ ID NOs: 235-276; and wherein the genomic sequence is at least 50 consecutive nucleotides in length, and/or fewer than 9000 consecutive nucleotides in length; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of the transcription termination sequence of the endogenous Zm.SAMT gene, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of the intergenic region between the endogenous GA20 oxidase_5 and Zm.SAMT genes, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of one or more of the following: 5' UTR, 1st exon, 1st intron, 2nd exon, 2nd intron, 3rd exon, 3' UTR, and any portion thereof, and the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any portion thereof, of the endogenous Zm.SAMT gene; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification which results in the transcription of an antisense strand of at least an exon, an intron, or an untranslated region (UTR) of the endogenous GA20 oxidase_5 gene, or any portion thereof; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises the Zm.SAMT gene promoter, or a functional part thereof, operably linked to at least one transcribable antisense sequence of at least an exon, intron or untranslated region (UTR) of the endogenous GA20 oxidase_5 gene, or any portion thereof; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a sequence selected from the group consisting of SEQ ID NOs: 304-322; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic deletion relative to a wild type allele of the endogenous GA20 oxidase_5 locus, wherein the genomic deletion is flanked by a first sequence and a second sequence; wherein the first sequence comprises one or more of the 5' UTR, 1st exon, 1st intron, 2nd exon, 2nd intron, 3rd exon, 3' UTR, and any complementary sequence thereof, and any portion of the foregoing, of the endogenous Zm.GA20 oxidase_5 gene; and wherein the second sequence comprises one or more of the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any complementary sequence thereof, and any portion of the foregoing, of the endogenous Zm.SAMT gene; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic deletion relative to a wild type allele of the endogenous GA20 oxidase_5 locus, wherein the genomic deletion is flanked by a first sequence and a second sequence; wherein the first sequence comprises one or more of the 5' UTR, 1st exon, 1st intron, 2nd exon, 2nd intron, 3rd exon, 3' UTR, and any complementary sequence thereof, and any portion of the foregoing, of the endogenous Zm.GA20 oxidase_5 gene; and wherein the second sequence comprises one or more of the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any complementary sequence thereof, and any portion of the foregoing, of the endogenous Zm.SAMT gene; and (b) harvesting said hybrid corn seeds from one or more of the female inbred corn plants.

In an aspect, this disclosure provides a method comprising: (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic sequence comprising a first sequence and a second sequence; wherein the first sequence comprises at least 15 consecutive nucleotides of one or more of SEQ ID NOs: 228-235 and 276-283; wherein the second sequence comprises at least 15 consecutive nucleotides of one or more of SEQ ID NOs: 235-276; and wherein the genomic sequence is at least 50 consecutive nucleotides in length, and/or fewer than 9000 consecutive nucleotides in length; and (b) harvesting said hybrid corn seeds from one or more of the female inbred corn plants.

Corn leaves consist of four main anatomical parts: a proximal sheath, a ligule, an auricle, and a distal blade. The sheath wraps around the stem and younger leaves, while the blade is flattened in the mediolateral axis (midrib to margin). The ligule and auricle are found at the blade/sheath boundary; the ligule is an adaxial (upper) membranous structure that acts as a collar around the stem, and the auricle is a projection on the lower surface of the blade base that connects the blade to the sheath. Stages of corn plant growth are divided into vegetative (V) stages and reproductive (R) stages. Upon germination, a corn plant is in the VE stage (emergence). Once the first leaf collar (e.g., the ligule) is visible, the corn plant is in the V1 stage. The emergence of the second leaf collar signifies V2 stage; the emergence of the third leaf collar signifies the V3 stage; and so on until the tassel emerges. For example, if twelve leaf collars are visible, the plant is a V12 stage plant. Once the bottom-most branch of the tassel emerges the plant is in VT stage, which is the final vegetative stage. The reproductive stage of growth occurs after the vegetative stage. The number of vegetative stages prior to VT stage can vary by environment and corn line. The first reproductive stage (R1; silking stage) occurs when silk is visible outside the husk leaves surrounding an ear of corn. R2 (blistering stage) occurs when corn kernels are white on the outside and are filled with a clear liquid inside. R3 (milk stage) occurs when the kernels are yellow on the outside and are filled with a milky white fluid inside. R4 (dough stage) occurs when the kernels are filled with a thick, or pasty, fluid. In some corn lines the cob will also turn pink or red at this stage. R5 (dent stage) occurs when a majority of the kernels are at least partially dented. The final reproductive stage, R6 (physiological maturity), occurs when the kernels have attained their maximum dry weight.

The height of a corn plant can be measured using a variety of methods known in the art. The height of a corn plant can also be determined based on a variety of anatomical locations on a corn plant. In an aspect, the height of a corn plant is measured as the distance between the soil or ground and the ligule of the uppermost fully-expanded leaf of the corn plant. As used herein, a "fully-expanded leaf" is a leaf where the leaf blade is exposed and both the ligule and auricle are visible at the blade/sheath boundary. In another aspect, the height of a corn plant is measured as the distance between the soil or ground and the upper leaf surface of the leaf farthest from the soil. In another aspect, the height of a corn plant is measured as the distance between the soil or ground and the arch of the highest corn leaf that is at least 50% developed. As used herein, an “arch of the highest corn leaf” is the highest point of the arch of the uppermost leaf of the corn plant that is curving downward. In another aspect, the height of a corn plant is measured at the first reproductive (R1) stage. Exemplary, non-limiting methods of measuring plant height include comparing photographs of corn plants to a height reference, or physically measuring individual corn plants with a suitable ruler.

As used herein, the term “ground” or “ground level” used in relation to a corn plant, such as to measure plant height, refers to the top or uppermost surface of the growth medium or soil (e.g., earth) from which the corn plant grows.

Corn plant height varies depending on the line or variety grown, whether the plant is a hybrid or inbred, and environmental conditions. Although hybrid corn plants can reach a height of over 3.6 meters tall by maturity, a height of around 2.0-2.5 meters by maturity for hybrid plants is more common. Inbred corn lines tend to be shorter than hybrids and can commonly have an average plant height ranging from about 1.75 meters to about 2.25 meters, or from about 1.85 meters to about 2.25 meters, or from about 1.95 meters to about 2.25 meters, or from about 2.05 meters to about 2.25 meters, or from about 1.85 to about 2.35 meters, or from about 1.95 meters to about 2.35 meters, or from about 2.05 meters to about 2.35 meters, or from about 2.15 meters to about 2.35 meters, or from about 1.8 meters to about 2.0 meters, or from about 1.8 meters to about 2.1 meters, or from about 1.8 meters to about 2.2 meters, or from about 1.8 meters to about 2.3 meters, or from about 1.9 meters to about 2.1 meters, or from about 1.9 meters to about 2.2 meters, or from about 1.9 meters to about 2.3 meters, or from about 2.0 meters to 2.2 meters, or from about 2.0 meters to 2.3 meters, or from about 1.75 meters to about 2.35 meters. According to some embodiments, a corn line or variety, or transgenic, mutated or edited corn plant, or a plurality or population of such a line, variety, transgenic, mutated, or edited corn plant, is provided having a reduced average plant height at maturity relative to a control plant of about 2.3 meters or less, about 2.2 meters or less, about 2.1 meters or less, about 2.0 meters or less, about 1.9 meters or less, about 1.8 meters or less, about 1.7 meters or less, about 1.6 meters or less, or about 1.5 meters or less.

The “average height” of a group of corn plants is the height obtained by dividing the sum of the heights of all plants within the group by the total number of plants within the group. For clarity, an “average height” for one plant is simply the height of that plant (i.e., its height divided by “1” equals its height).

In an aspect, the average height of the female inbred corn plants provided herein is at least 2% less or lower than the height (or average height) of at least one male inbred corn plant(s) (or the average plant height of male inbred corn plants) provided herein. In an aspect, the average height of the female inbred corn plants provided herein is at least 2.5% less or lower than the height (or average height) of at least one male inbred corn plant(s) (or the average plant height of male inbred corn plants) provided herein. In an aspect, the average height of the female inbred corn plants provided herein is at least 3% less or lower than the height (or average height) of at least one male inbred corn plant(s) (or the average plant height of male inbred corn plants) provided herein. In an aspect, the average height of the female inbred corn plants provided herein is at least 4% less or lower than the height (or average height) of at least one male inbred corn plant(s) (or the average plant height of male inbred corn plants) provided herein. In an aspect, the average height of the female inbred corn plants provided herein is at least 5% less or lower than the height (or average height) of at least one male inbred corn plant(s) provided herein. In an aspect, the average height of the female inbred corn plants provided herein is at least 10% less or lower than the height (or average height) of at least one male inbred corn plant(s) provided herein. In another aspect, the average height of the female inbred corn plants provided herein is at least 15% less or lower than the height (or average height) of at least one male inbred corn plant(s) provided herein. In another aspect, the average height of the female inbred corn plants provided herein is at least 20% less or lower than the height (or average height) of at least one male inbred corn plant(s) provided herein. In another aspect, the average height of the female inbred corn plants provided herein is at least 25% less or lower than the height (or average height) of at least one male inbred corn plant provided herein. In another aspect, the average height of the female inbred corn plants provided herein is at least 30% less or lower than the height (or average height) of at least one male inbred corn plant(s) provided herein. In another aspect, the average height of the female inbred corn plants provided herein is at least 35% less or lower than the height (or average height) of at least one male inbred corn plant(s) provided herein. In another aspect, the average height of the female inbred corn plants provided herein is at least 40% less or lower than the height (or average height) of at least one male inbred corn plant(s) provided herein. In another aspect, the average height of the female inbred corn plants provided herein is at least 45% less or lower than the height (or average height) of at least one male inbred corn plant(s) provided herein. In another aspect, the average height of the female inbred corn plants provided herein is at least 50% less or lower than the height (or average height) of at least one male inbred corn plant(s) provided herein. In another aspect, the average height of the female inbred corn plants provided herein is at least 55% less or lower than the height (or average height) of at least one male inbred corn plant(s) provided herein. In another aspect, the average height of the female inbred corn plants provided herein is at least 60% less or lower than the height (or average height) of at least one male inbred corn plant(s) provided herein. In another aspect, the average height of the female inbred corn plants provided herein is at least 65% less or lower than the height (or average height) of at least one male inbred corn plant(s) provided herein. In another aspect, the average height of the female inbred corn plants provided herein is at least 70% less or lower than the height (or average height) of at least one male inbred corn plant(s) provided herein. In another aspect, the average height of the female inbred corn plants provided herein is at least 75% less or lower than the height (or average height) of at least one male inbred corn plant(s) provided herein.

Corn plant height can be measured according to two different methods. According to one method, corn plant height is measured from the ground or soil to the ligule (or collar) of the uppermost fully expanded leaf—i.e., from the ground or soil to the base of the uppermost collared leaf. According to another method, corn plant height is measured from the ground or soil to the uppermost leaf surface of the leaf farthest from the soil. This latter method will typically give a higher plant height than the former method due to measuring a feature of the plant that is further from the ground. According to another method for measuring the height of a corn plant during and after VT stage, plant height can be measured from the ground or soil to the tops of the tassel. Relative plant heights and percentage differences in plant height as provided herein may be applied to each of these methods. For purposes of clarity, however, if the method for measuring plant height is not expressly stated herein, then the plant height is measured as the distance between the ground or soil and the ligule (or collar) of the uppermost fully expanded leaf—i.e., from the ground or soil to the base of the uppermost collared leaf.

According to embodiments of the present disclosure, corn plant heights, average corn plant heights, male-to-female or female-to-male corn plant height differences, male-to-female or female-to-male average corn plant height differences, male-to-female average plant height ratios, female-to-male average plant height ratios, male-to-female plant height ratios, and female-to-male plant height ratios as described herein may be at or during a late vegetative and/or a reproductive stage of development when tassel formation and extension, pollen shed, silking, pollination, and/or kernel or ear development occurs, such as V12, V13, V14, V15, Vn, VT, R1, R2, R3, R4, R5, and/or R6 stage, such as VT or R1 stage. If the developmental stage is not specified or stated, then the corn plant height(s), average corn plant height(s), male-to-female or female-to-male corn plant height difference(s), male-to-female plant height ratio(s), and/or female-to-male plant height ratio(s) as described herein is at R1 stage. According to present embodiments, corn developmental stages are defined according to the Iowa State University (ISU) method. See, e.g., Ritchie, S. W. et al., How a corn plant develops. Special Report No. 48, Iowa State University, CES, Ames, Iowa, reprinted 1996, the entire contents and disclosure of which are incorporated herein by reference.

In an aspect, the female inbred corn plants provided herein comprise an average height that is between 2% and 30% less or lower than the height (or average height) of at least one male inbred corn plant(s) (or the average plant height of male inbred corn plants) provided herein. In an aspect, the female inbred corn plants provided herein comprise an average height that is between 2% and 25% less or lower than the height (or average height) of at least one male inbred corn plant(s) (or the average plant height of male inbred corn plants) provided herein. In an aspect, the female inbred corn plants provided herein comprise an average height that is between 2% and 20% less or lower than the height (or average height) of at least one male inbred corn plant(s) (or the average plant height of male inbred corn plants) provided herein. In an aspect, the female inbred corn plants provided herein comprise an average height that is between 2% and 15% less or lower than the height (or average height) of at least one male inbred corn plant(s) (or the average plant height of male inbred corn plants) provided herein. In an aspect, the female inbred corn plants provided herein comprise an average height that is between 2% and 10% less or lower than the height (or average height) of at least one male inbred corn plant(s) (or the average plant height of male inbred corn plants) provided herein. In an aspect, the female inbred corn plants provided herein comprise an average height that is between 2% and 5% less or lower than the height (or average height) of at least one male inbred corn plant(s) (or the average plant height of male inbred corn plants) provided herein. In an aspect, the female inbred corn plants provided herein comprise an average height that is between 2.5% and 30% less or lower than the height (or average height) of at least one male inbred corn plant(s) (or the average plant height of male inbred corn plants) provided herein. In an aspect, the female inbred corn plants provided herein comprise an average height that is between 2.5% and 25% less or lower than the height of at least one male inbred corn plant(s) (or the average plant height of male inbred corn plants) provided herein. In an aspect, the female inbred corn plants provided herein comprise an average height that is between 2.5% and 20% less or lower than the height of at least one male inbred corn plant(s) (or the average plant height of male inbred corn plants) provided herein. In an aspect, the female inbred corn plants provided herein comprise an average height that is between 2.5% and 15% less or lower than the height of at least one male inbred corn plant(s) (or the average plant height of male inbred corn plants) provided herein. In an aspect, the female inbred corn plants provided herein comprise an average height that is between 2.5% and 10% less or lower than the height (or average height) of at least one male inbred corn plant(s) (or the average plant height of male inbred corn plants) provided herein. In an aspect, the female inbred corn plants provided herein comprise an average height that is between 2.5% and 5% less or lower than the height (or average height) of at least one male inbred corn plant(s) (or the average plant height of male inbred corn plants) provided herein.

In an aspect, the female inbred corn plants provided herein comprise an average height that is between 5% and 50% less or lower than the height (or average height) of at least one male inbred corn plant(s) (or the average plant height of male inbred corn plants) provided herein. In an aspect, the female inbred corn plants provided herein comprise an average height that is between 5% and 40% less or lower than the height (or average height) of at least one male inbred corn plant(s) (or the average plant height of male inbred corn plants) provided herein. In an aspect, the female inbred corn plants provided herein comprise an average height that is between 5% and 30% less or lower than the height (or average height) of at least one male inbred corn plant(s) (or the average plant height of male inbred corn plants) provided herein. In an aspect, the female inbred corn plants provided herein comprise an average height that is between 5% and 25% less or lower than the height (or average height) of at least one male inbred corn plant(s) (or the average plant height of male inbred corn plants) provided herein. In an aspect, the female inbred corn plants provided herein comprise an average height that is between 5% and 20% less or lower than the height of at least one male inbred corn plant(s) (or the average plant height of male inbred corn plants) provided herein. In an aspect, the female inbred corn plants provided herein comprise an average height that is between 5% and 15% less or lower than the height of at least one male inbred corn plant(s) (or the average plant height of male inbred corn plants) provided herein. In an aspect, the female inbred corn plants provided herein comprise an average height that is between 5% and 10% less or lower than the height of at least one male inbred corn plant(s) (or the average plant height of male inbred corn plants) provided herein.

In an aspect, the female inbred corn plants provided herein comprise an average height that is between 10% and 50% less or lower than the height (or average height) of at least one male inbred corn plant(s) (or the average plant height of male inbred corn plants) provided herein. In an aspect, the female inbred corn plants provided herein comprise an average height that is between 10% and 40% less or lower than the height (or average height) of at least one male inbred corn plant(s) (or the average plant height of male inbred corn plants) provided herein. In an aspect, the female inbred corn plants provided herein comprise an average height that is between 10% and 30% less or lower than the height (or average height) of at least one male inbred corn plant(s) (or the average plant height of male inbred corn plants) provided herein. In an aspect, the female inbred corn plants provided herein comprise an average height that is between 10% and 25% less or lower than the height (or average height) of at least one male inbred corn plant(s) (or the average plant height of male inbred corn plants) provided herein. In an aspect, the female inbred corn plants provided herein comprise an average height that is between 10% and 20% less or lower than the height (or average height) of at least one male inbred corn plant(s) (or the average plant height of male inbred corn plants) provided herein. In an aspect, the female inbred corn plants provided herein comprise an average height that is between 10% and 15% less or lower than the height (or average height) of at least one male inbred corn plant(s) (or the average plant height of male inbred corn plants) provided herein.

In another aspect, the female inbred corn plants provided herein comprise an average height that is between 15% and 60% less or lower than the height (or average height) of at least one male inbred corn plant(s) (or the average plant height of male inbred corn plants) provided herein. In another aspect, the female inbred corn plants provided herein comprise an average height that is between 15% and 50% less or lower than the height (or average height) of at least one male inbred corn plant(s) (or the average plant height of male inbred corn plants) provided herein. In another aspect, the female inbred corn plants provided herein comprise an average height that is between 15% and 40% less or lower than the height (or average height) of at least one male inbred corn plant(s) (or the average plant height of male inbred corn plants) provided herein. In another aspect, the female inbred corn plants provided herein comprise an average height that is between 15% and 30% less or lower than the height (or average height) of at least one male inbred corn plant(s) (or the average plant height of male inbred corn plants) provided herein. In another aspect, the female inbred corn plants provided herein comprise an average height that is between 15% and 25% less or lower than the height (or average height) of at least one male inbred corn plant(s) (or the average plant height of male inbred corn plants) provided herein. In another aspect, the female inbred corn plants provided herein comprise an average height that is between 15% and 20% less or lower than the height (or average height) of at least one male inbred corn plant(s) (or the average plant height of male inbred corn plants) provided herein.

In another aspect, the female inbred corn plants provided herein comprise an average height that is between 20% and 70% less or lower than the height (or average height) of at least one male inbred corn plant(s) (or the average plant height of male inbred corn plants) provided herein. In another aspect, the female inbred corn plants provided herein comprise an average height that is between 20% and 60% less or lower than the height (or average height) of at least one male inbred corn plant(s) (or the average plant height of male inbred corn plants) provided herein. In another aspect, the female inbred corn plants provided herein comprise an average height that is between 20% and 50% less or lower than the height (or average height) of at least one male inbred corn plant(s) (or the average plant height of male inbred corn plants) provided herein. In another aspect, the female inbred corn plants provided herein comprise an average height that is between 20% and 40% less or lower than the height (or average height) of at least one male inbred corn plant(s) (or the average plant height of male inbred corn plants) provided herein. In another aspect, the female inbred corn plants provided herein comprise an average height that is between 20% and 30% less or lower than the height (or average height) of at least one male inbred corn plant(s) (or the average plant height of male inbred corn plants) provided herein.

In an aspect, the average height of the female inbred corn plants provided herein is at least 0.05 meters less or lower than the height (or average height) of at least one male inbred corn plant(s) (or the average plant height of male inbred corn plants) provided herein. In an aspect, the average height of the female inbred corn plants provided herein is at least 0.06 meters less or lower than the height (or average height) of at least one male inbred corn plant(s) (or the average plant height of male inbred corn plants) provided herein. In an aspect, the average height of the female inbred corn plants provided herein is at least 0.07 meters less or lower than the height (or average height) of at least one male inbred corn plant(s) (or the average plant height of male inbred corn plants) provided herein. In an aspect, the average height of the female inbred corn plants provided herein is at least 0.08 meters less or lower than the height (or average height) of at least one male inbred corn plant(s) (or the average plant height of male inbred corn plants) provided herein. In an aspect, the average height of the female inbred corn plants provided herein is at least 0.09 meters less or lower than the height (or average height) of at least one male inbred corn plant(s) (or the average plant height of male inbred corn plants) provided herein. In an aspect, the average height of the female inbred corn plants provided herein is at least 0.1 meters less or lower than the height (or average height) of at least one male inbred corn plant(s) (or the average plant height of male inbred corn plants) provided herein. In another aspect, the average height of the female inbred corn plants provided herein is at least 0.2 meters less or lower than the height (or average height) of at least one male inbred corn plant(s) (or the average plant height of male inbred corn plants) provided herein. In another aspect, the average height of the female inbred corn plants provided herein is at least 0.3 meters less or lower than the height (or average height) of at least one male inbred corn plant(s) (or the average plant height of male inbred corn plants) provided herein. In another aspect, the average height of the female inbred corn plants provided herein is at least 0.4 meters less or lower than the height (or average height) of at least one male inbred corn plant(s) (or the average plant height of male inbred corn plants) provided herein. In another aspect, the average height of the female inbred corn plants provided herein is at least 0.5 meters less or lower than the height (or average height) of at least one male inbred corn plant(s) (or the average plant height of male inbred corn plants) provided herein. In another aspect, the average height of the female inbred corn plants provided herein is at least 0.6 meters less or lower than the height (or average height) of at least one male inbred corn plant(s) (or the average plant height of male inbred corn plants) provided herein. In another aspect, the average height of the female inbred corn plants provided herein is at least 0.7 meters less or lower than the height (or average height) of at least one male inbred corn plant(s) (or the average plant height of male inbred corn plants) provided herein. In another aspect, the average height of the female inbred corn plants provided herein is at least 0.8 meters less or lower than the height (or average height) of at least one male inbred corn plant(s) (or the average plant height of male inbred corn plants) provided herein. In another aspect, the average height of the female inbred corn plants provided herein is at least 0.9 meters less or lower than the height (or average height) of at least one male inbred corn plant(s) (or the average plant height of male inbred corn plants) provided herein. In another aspect, the average height of the female inbred corn plants provided herein is at least 1.0 meters less or lower than the height (or average height) of at least one male inbred corn plant(s) (or the average plant height of male inbred corn plants) provided herein. In another aspect, the average height of the female inbred corn plants provided herein is at least 1.2 meters less or lower than the height (or average height) of at least one male inbred corn plant(s) (or the average plant height of male inbred corn plants) provided herein. In another aspect, the average height of the female inbred corn plants provided herein is at least 1.4 meters less or lower than the height (or average height) of at least one male inbred corn plant(s) (or the average plant height of male inbred corn plants) provided herein. In another aspect, the average height of the female inbred corn plants provided herein is at least 1.6 meters less or lower than the height (or average height) of at least one male inbred corn plant(s) (or the average plant height of male inbred corn plants) provided herein. In another aspect, the average height of the female inbred corn plants provided herein is at least 1.8 meters less or lower than the height (or average height) of at least one male inbred corn plant(s) (or the average plant height of male inbred corn plants) provided herein. In another aspect, the average height of the female inbred corn plants provided herein is at least 2.0 meters less or lower than the height (or average height) of at least one male inbred corn plant(s) (or the average plant height of male inbred corn plants) provided herein. In another aspect, the average height of the female inbred corn plants provided herein is at least 2.2 meters less or lower than the height (or average height) of at least one male inbred corn plant(s) (or the average plant height of male inbred corn plants) provided herein.

In an aspect, the female inbred corn plants provided herein comprise an average height that is between 0.05 and 1.0 meters less or lower than the height (or average height) of at least one male inbred corn plant(s) (or the average plant height of male inbred corn plants) provided herein. In an aspect, the female inbred corn plants provided herein comprise an average height that is between 0.05 and 0.9 meters less or lower than the height (or average height) of at least one male inbred corn plant(s) (or the average plant height of male inbred corn plants) provided herein. In an aspect, the female inbred corn plants provided herein comprise an average height that is between 0.05 and 0.8 meters less or lower than the height (or average height) of at least one male inbred corn plant(s) (or the average plant height of male inbred corn plants) provided herein. In an aspect, the female inbred corn plants provided herein comprise an average height that is between 0.05 and 0.7 meters less or lower than the height (or average height) of at least one male inbred corn plant(s) (or the average plant height of male inbred corn plants) provided herein. In an aspect, the female inbred corn plants provided herein comprise an average height that is between 0.05 and 0.6 meters less or lower than the height (or average height) of at least one male inbred corn plant(s) (or the average plant height of male inbred corn plants) provided herein. In an aspect, the female inbred corn plants provided herein comprise an average height that is between 0.05 and 0.5 meters less or lower than the height (or average height) of at least one male inbred corn plant(s) (or the average plant height of male inbred corn plants) provided herein. In an aspect, the female inbred corn plants provided herein comprise an average height that is between 0.05 and 0.4 meters less or lower than the height (or average height) of at least one male inbred corn plant(s) (or the average plant height of male inbred corn plants) provided herein. In an aspect, the female inbred corn plants provided herein comprise an average height that is between 0.05 and 0.3 meters less or lower than the height (or average height) of at least one male inbred corn plant(s) (or the average plant height of male inbred corn plants) provided herein. In an aspect, the female inbred corn plants provided herein comprise an average height that is between 0.05 and 0.2 meters less or lower than the height (or average height) of at least one male inbred corn plant(s) (or the average plant height of male inbred corn plants) provided herein. In an aspect, the female inbred corn plants provided herein comprise an average height that is between 0.05 and 0.1 meters less or lower than the height (or average height) of at least one male inbred corn plant(s) (or the average plant height of male inbred corn plants) provided herein.

In an aspect, the female inbred corn plants provided herein comprise an average height that is between 0.06 and 1.0 meters less or lower than the height (or average height) of at least one male inbred corn plant(s) (or the average plant height of male inbred corn plants) provided herein. In an aspect, the female inbred corn plants provided herein comprise an average height that is between 0.06 and 0.9 meters less or lower than the height (or average height) of at least one male inbred corn plant(s) (or the average plant height of male inbred corn plants) provided herein. In an aspect, the female inbred corn plants provided herein comprise an average height that is between 0.06 and 0.8 meters less or lower than the height (or average height) of at least one male inbred corn plant(s) (or the average plant height of male inbred corn plants) provided herein. In an aspect, the female inbred corn plants provided herein comprise an average height that is between 0.06 and 0.7 meters less or lower than the height (or average height) of at least one male inbred corn plant(s) (or the average plant height of male inbred corn plants) provided herein. In an aspect, the female inbred corn plants provided herein comprise an average height that is between 0.06 and 0.6 meters less or lower than the height (or average height) of at least one male inbred corn plant(s) (or the average plant height of male inbred corn plants) provided herein. In an aspect, the female inbred corn plants provided herein comprise an average height that is between 0.06 and 0.5 meters less or lower than the height (or average height) of at least one male inbred corn plant(s) (or the average plant height of male inbred corn plants) provided herein. In an aspect, the female inbred corn plants provided herein comprise an average height that is between 0.06 and 0.4 meters less or lower than the height (or average height) of at least one male inbred corn plant(s) (or the average plant height of male inbred corn plants) provided herein. In an aspect, the female inbred corn plants provided herein comprise an average height that is between 0.06 and 0.3 meters less or lower than the height (or average height) of at least one male inbred corn plant(s) (or the average plant height of male inbred corn plants) provided herein. In an aspect, the female inbred corn plants provided herein comprise an average height that is between 0.06 and 0.2 meters less or lower than the height (or average height) of at least one male inbred corn plant(s) (or the average plant height of male inbred corn plants) provided herein. In an aspect, the female inbred corn plants provided herein comprise an average height that is between 0.06 and 0.1 meters less or lower than the height (or average height) of at least one male inbred corn plant(s) (or the average plant height of male inbred corn plants) provided herein.

In an aspect, the female inbred corn plants provided herein comprise an average height that is between 0.07 and 1.0 meters less or lower than the height (or average height) of at least one male inbred corn plant(s) (or the average plant height of male inbred corn plants) provided herein. In an aspect, the female inbred corn plants provided herein comprise an average height that is between 0.07 and 0.9 meters less or lower than the height (or average height) of at least one male inbred corn plant(s) (or the average plant height of male inbred corn plants) provided herein. In an aspect, the female inbred corn plants provided herein comprise an average height that is between 0.07 and 0.8 meters less or lower than the height (or average height) of at least one male inbred corn plant(s) (or the average plant height of male inbred corn plants) provided herein. In an aspect, the female inbred corn plants provided herein comprise an average height that is between 0.07 and 0.7 meters less or lower than the height (or average height) of at least one male inbred corn plant(s) (or the average plant height of male inbred corn plants) provided herein. In an aspect, the female inbred corn plants provided herein comprise an average height that is between 0.07 and 0.6 meters less or lower than the height (or average height) of at least one male inbred corn plant(s) (or the average plant height of male inbred corn plants) provided herein. In an aspect, the female inbred corn plants provided herein comprise an average height that is between 0.07 and 0.5 meters less or lower than the height (or average height) of at least one male inbred corn plant(s) (or the average plant height of male inbred corn plants) provided herein. In an aspect, the female inbred corn plants provided herein comprise an average height that is between 0.07 and 0.4 meters less or lower than the height (or average height) of at least one male inbred corn plant(s) (or the average plant height of male inbred corn plants) provided herein. In an aspect, the female inbred corn plants provided herein comprise an average height that is between 0.07 and 0.3 meters less or lower than the height (or average height) of at least one male inbred corn plant(s) (or the average plant height of male inbred corn plants) provided herein. In an aspect, the female inbred corn plants provided herein comprise an average height that is between 0.07 and 0.2 meters less or lower than the height (or average height) of at least one male inbred corn plant(s) (or the average plant height of male inbred corn plants) provided herein. In an aspect, the female inbred corn plants provided herein comprise an average height that is between 0.07 and 0.1 meters less or lower than the height (or average height) of at least one male inbred corn plant(s) (or the average plant height of male inbred corn plants) provided herein.

In an aspect, the female inbred corn plants provided herein comprise an average height that is between 0.08 and 1.0 meters less or lower than the height (or average height) of at least one male inbred corn plant(s) (or the average plant height of male inbred corn plants) provided herein. In an aspect, the female inbred corn plants provided herein comprise an average height that is between 0.08 and 0.9 meters less or lower than the height (or average height) of at least one male inbred corn plant(s) (or the average plant height of male inbred corn plants) provided herein. In an aspect, the female inbred corn plants provided herein comprise an average height that is between 0.08 and 0.8 meters less or lower than the height (or average height) of at least one male inbred corn plant(s) (or the average plant height of male inbred corn plants) provided herein. In an aspect, the female inbred corn plants provided herein comprise an average height that is between 0.08 and 0.7 meters less or lower than the height (or average height) of at least one male inbred corn plant(s) (or the average plant height of male inbred corn plants) provided herein. In an aspect, the female inbred corn plants provided herein comprise an average height that is between 0.08 and 0.6 meters less or lower than the height (or average height) of at least one male inbred corn plant(s) (or the average plant height of male inbred corn plants) provided herein. In an aspect, the female inbred corn plants provided herein comprise an average height that is between 0.08 and 0.5 meters less or lower than the height (or average height) of at least one male inbred corn plant(s) (or the average plant height of male inbred corn plants) provided herein. In an aspect, the female inbred corn plants provided herein comprise an average height that is between 0.08 and 0.4 meters less or lower than the height (or average height) of at least one male inbred corn plant(s) (or the average plant height of male inbred corn plants) provided herein. In an aspect, the female inbred corn plants provided herein comprise an average height that is between 0.08 and 0.3 meters less or lower than the height (or average height) of at least one male inbred corn plant(s) (or the average plant height of male inbred corn plants) provided herein. In an aspect, the female inbred corn plants provided herein comprise an average height that is between 0.08 and 0.2 meters less or lower than the height (or average height) of at least one male inbred corn plant(s) (or the average plant height of male inbred corn plants) provided herein. In an aspect, the female inbred corn plants provided herein comprise an average height that is between 0.08 and 0.1 meters less or lower than the height (or average height) of at least one male inbred corn plant(s) (or the average plant height of male inbred corn plants) provided herein.

In an aspect, the female inbred corn plants provided herein comprise an average height that is between 0.09 and 1.0 meters less or lower than the height (or average height) of at least one male inbred corn plant(s) (or the average plant height of male inbred corn plants) provided herein. In an aspect, the female inbred corn plants provided herein comprise an average height that is between 0.09 and 0.9 meters less or lower than the height (or average height) of at least one male inbred corn plant(s) (or the average plant height of male inbred corn plants) provided herein. In an aspect, the female inbred corn plants provided herein comprise an average height that is between 0.09 and 0.8 meters less or lower than the height (or average height) of at least one male inbred corn plant(s) (or the average plant height of male inbred corn plants) provided herein. In an aspect, the female inbred corn plants provided herein comprise an average height that is between 0.09 and 0.7 meters less or lower than the height (or average height) of at least one male inbred corn plant(s) (or the average plant height of male inbred corn plants) provided herein. In an aspect, the female inbred corn plants provided herein comprise an average height that is between 0.09 and 0.6 meters less or lower than the height (or average height) of at least one male inbred corn plant(s) (or the average plant height of male inbred corn plants) provided herein. In an aspect, the female inbred corn plants provided herein comprise an average height that is between 0.09 and 0.5 meters less or lower than the height (or average height) of at least one male inbred corn plant(s) (or the average plant height of male inbred corn plants) provided herein. In an aspect, the female inbred corn plants provided herein comprise an average height that is between 0.09 and 0.4 meters less or lower than the height (or average height) of at least one male inbred corn plant(s) (or the average plant height of male inbred corn plants) provided herein. In an aspect, the female inbred corn plants provided herein comprise an average height that is between 0.09 and 0.3 meters less or lower than the height (or average height) of at least one male inbred corn plant(s) (or the average plant height of male inbred corn plants) provided herein. In an aspect, the female inbred corn plants provided herein comprise an average height that is between 0.09 and 0.2 meters less or lower than the height (or average height) of at least one male inbred corn plant(s) (or the average plant height of male inbred corn plants) provided herein. In an aspect, the female inbred corn plants provided herein comprise an average height that is between 0.09 and 0.1 meters less or lower than the height (or average height) of at least one male inbred corn plant(s) (or the average plant height of male inbred corn plants) provided herein.

In an aspect, the female inbred corn plants provided herein comprise an average height that is between 0.1 and 1.5 meters less or lower than the height (or average height) of at least one male inbred corn plant(s) (or the average plant height of male inbred corn plants) provided herein. In an aspect, the female inbred corn plants provided herein comprise an average height that is between 0.1 and 1.4 meters less or lower than the height (or average height) of at least one male inbred corn plant(s) (or the average plant height of male inbred corn plants) provided herein. In an aspect, the female inbred corn plants provided herein comprise an average height that is between 0.1 and 1.3 meters less or lower than the height (or average height) of at least one male inbred corn plant(s) (or the average plant height of male inbred corn plants) provided herein. In an aspect, the female inbred corn plants provided herein comprise an average height that is between 0.1 and 1.2 meters less or lower than the height (or average height) of at least one male inbred corn plant(s) (or the average plant height of male inbred corn plants) provided herein. In an aspect, the female inbred corn plants provided herein comprise an average height that is between 0.1 and 1.1 meters less or lower than the height (or average height) of at least one male inbred corn plant(s) (or the average plant height of male inbred corn plants) provided herein. In an aspect, the female inbred corn plants provided herein comprise an average height that is between 0.1 and 1.0 meters less or lower than the height (or average height) of at least one male inbred corn plant(s) (or the average plant height of male inbred corn plants) provided herein. In an aspect, the female inbred corn plants provided herein comprise an average height that is between 0.1 and 0.9 meters less or lower than the height (or average height) of at least one male inbred corn plant(s) (or the average plant height of male inbred corn plants) provided herein. In an aspect, the female inbred corn plants provided herein comprise an average height that is between 0.1 and 0.8 meters less or lower than the height (or average height) of at least one male inbred corn plant(s) (or the average plant height of male inbred corn plants) provided herein. In an aspect, the female inbred corn plants provided herein comprise an average height that is between 0.1 and 0.7 meters less or lower than the height (or average height) of at least one male inbred corn plant(s) (or the average plant height of male inbred corn plants) provided herein. In an aspect, the female inbred corn plants provided herein comprise an average height that is between 0.1 and 0.6 meters less or lower than the height (or average height) of at least one male inbred corn plant(s) (or the average plant height of male inbred corn plants) provided herein. In an aspect, the female inbred corn plants provided herein comprise an average height that is between 0.1 and 0.5 meters less or lower than the height (or average height) of at least one male inbred corn plant(s) (or the average plant height of male inbred corn plants) provided herein. In an aspect, the female inbred corn plants provided herein comprise an average height that is between 0.1 and 0.4 meters less or lower than the height (or average height) of at least one male inbred corn plant(s) (or the average plant height of male inbred corn plants) provided herein. In an aspect, the female inbred corn plants provided herein comprise an average height that is between 0.1 and 0.3 meters less or lower than the height (or average height) of at least one male inbred corn plant(s) (or the average plant height of male inbred corn plants) provided herein. In an aspect, the female inbred corn plants provided herein comprise an average height that is between 0.1 and 0.2 meters less or lower than the height (or average height) of at least one male inbred corn plant(s) (or the average plant height of male inbred corn plants) provided herein.

In another aspect, the female inbred corn plants provided herein comprise an average height that is between 0.2 and 1.5 meters less or lower than the height (or average height) of at least one male inbred corn plant(s) (or the average plant height of male inbred corn plants) provided herein. In another aspect, the female inbred corn plants provided herein comprise an average height that is between 0.2 and 1.4 meters less or lower than the height (or average height) of at least one male inbred corn plant(s) (or the average plant height of male inbred corn plants) provided herein. In another aspect, the female inbred corn plants provided herein comprise an average height that is between 0.2 and 1.3 meters less or lower than the height (or average height) of at least one male inbred corn plant(s) (or the average plant height of male inbred corn plants) provided herein. In another aspect, the female inbred corn plants provided herein comprise an average height that is between 0.2 and 1.2 meters less or lower than the height (or average height) of at least one male inbred corn plant(s) (or the average plant height of male inbred corn plants) provided herein. In another aspect, the female inbred corn plants provided herein comprise an average height that is between 0.2 and 1.1 meters less or lower than the height (or average height) of at least one male inbred corn plant(s) (or the average plant height of male inbred corn plants) provided herein. In another aspect, the female inbred corn plants provided herein comprise an average height that is between 0.2 and 1.0 meters less or lower than the height (or average height) of at least one male inbred corn plant(s) (or the average plant height of male inbred corn plants) provided herein. In another aspect, the female inbred corn plants provided herein comprise an average height that is between 0.2 and 0.9 meters less or lower than the height (or average height) of at least one male inbred corn plant(s) (or the average plant height of male inbred corn plants) provided herein. In another aspect, the female inbred corn plants provided herein comprise an average height that is between 0.2 and 0.8 meters less or lower than the height (or average height) of at least one male inbred corn plant(s) (or the average plant height of male inbred corn plants) provided herein. In another aspect, the female inbred corn plants provided herein comprise an average height that is between 0.2 and 0.7 meters less or lower than the height (or average height) of at least one male inbred corn plant(s) (or the average plant height of male inbred corn plants) provided herein. In another aspect, the female inbred corn plants provided herein comprise an average height that is between 0.2 and 0.6 meters less or lower than the height (or average height) of at least one male inbred corn plant(s) (or the average plant height of male inbred corn plants) provided herein. In another aspect, the female inbred corn plants provided herein comprise an average height that is between 0.2 and 0.5 meters less or lower than the height (or average height)

of at least one male inbred corn plant(s) (or the average plant height of male inbred corn plants) provided herein. In another aspect, the female inbred corn plants provided herein comprise an average height that is between 0.2 and 0.4 meters less or lower than the height (or average height) of at least one male inbred corn plant(s) (or the average plant height of male inbred corn plants) provided herein. In another aspect, the female inbred corn plants provided herein comprise an average height that is between 0.2 and 0.3 meters less or lower than the height (or average height) of at least one male inbred corn plant(s) (or the average plant height of male inbred corn plants) provided herein.

In another aspect, the female inbred corn plants provided herein comprise an average height that is between 0.3 and 1.5 meters less or lower than the height (or average height) of at least one male inbred corn plant(s) (or the average plant height of male inbred corn plants) provided herein. In another aspect, the female inbred corn plants provided herein comprise an average height that is between 0.3 and 1.4 meters less or lower than the height (or average height) of at least one male inbred corn plant(s) (or the average plant height of male inbred corn plants) provided herein. In another aspect, the female inbred corn plants provided herein comprise an average height that is between 0.3 and 1.3 meters less or lower than the height (or average height) of at least one male inbred corn plant(s) (or the average plant height of male inbred corn plants) provided herein. In another aspect, the female inbred corn plants provided herein comprise an average height that is between 0.3 and 1.2 meters less or lower than the height (or average height) of at least one male inbred corn plant(s) (or the average plant height of male inbred corn plants) provided herein. In another aspect, the female inbred corn plants provided herein comprise an average height that is between 0.3 and 1.1 meters less or lower than the height (or average height) of at least one male inbred corn plant(s) (or the average plant height of male inbred corn plants) provided herein. In another aspect, the female inbred corn plants provided herein comprise an average height that is between 0.3 and 1.0 meters less or lower than the height (or average height) of at least one male inbred corn plant(s) (or the average plant height of male inbred corn plants) provided herein. In another aspect, the female inbred corn plants provided herein comprise an average height that is between 0.3 and 0.9 meters less or lower than the height (or average height) of at least one male inbred corn plant(s) (or the average plant height of male inbred corn plants) provided herein. In another aspect, the female inbred corn plants provided herein comprise an average height that is between 0.3 and 0.8 meters less or lower than the height (or average height) of at least one male inbred corn plant(s) (or the average plant height of male inbred corn plants) provided herein. In another aspect, the female inbred corn plants provided herein comprise an average height that is between 0.3 and 0.7 meters less or lower than the height (or average height) of at least one male inbred corn plant(s) (or the average plant height of male inbred corn plants) provided herein. In another aspect, the female inbred corn plants provided herein comprise an average height that is between 0.3 and 0.6 meters less or lower than the height (or average height) of at least one male inbred corn plant(s) (or the average plant height of male inbred corn plants) provided herein. In another aspect, the female inbred corn plants provided herein comprise an average height that is between 0.3 and 0.5 meters less or lower than the height (or average height) of at least one male inbred corn plant(s) (or the average plant height of male inbred corn plants) provided herein. In another aspect, the female inbred corn plants provided herein comprise an average height that is between 0.3 and 0.4 meters less or lower than the height (or average height) of at least one male inbred corn plant(s) (or the average plant height of male inbred corn plants) provided herein.

In another aspect, the female inbred corn plants provided herein comprise an average height that is between 0.4 and 2.0 meters less or lower than the height (or average height) of at least one male inbred corn plant(s) (or the average plant height of male inbred corn plants) provided herein. In another aspect, the female inbred corn plants provided herein comprise an average height that is between 0.4 and 1.9 meters less or lower than the height (or average height) of at least one male inbred corn plant(s) (or the average plant height of male inbred corn plants) provided herein. In another aspect, the female inbred corn plants provided herein comprise an average height that is between 0.4 and 1.8 meters less or lower than the height (or average height) of at least one male inbred corn plant(s) (or the average plant height of male inbred corn plants) provided herein. In another aspect, the female inbred corn plants provided herein comprise an average height that is between 0.4 and 1.7 meters less or lower than the height (or average height) of at least one male inbred corn plant(s) (or the average plant height of male inbred corn plants) provided herein. In another aspect, the female inbred corn plants provided herein comprise an average height that is between 0.4 and 1.6 meters less or lower than the height (or average height) of at least one male inbred corn plant(s) (or the average plant height of male inbred corn plants) provided herein. In another aspect, the female inbred corn plants provided herein comprise an average height that is between 0.4 and 1.5 meters less or lower than the height (or average height) of at least one male inbred corn plant(s) (or the average plant height of male inbred corn plants) provided herein. In another aspect, the female inbred corn plants provided herein comprise an average height that is between 0.4 and 1.4 meters less or lower than the height (or average height) of at least one male inbred corn plant(s) (or the average plant height of male inbred corn plants) provided herein. In another aspect, the female inbred corn plants provided herein comprise an average height that is between 0.4 and 1.3 meters less or lower than the height (or average height) of at least one male inbred corn plant(s) (or the average plant height of male inbred corn plants) provided herein. In another aspect, the female inbred corn plants provided herein comprise an average height that is between 0.4 and 1.2 meters less or lower than the height (or average height) of at least one male inbred corn plant(s) (or the average plant height of male inbred corn plants) provided herein. In another aspect, the female inbred corn plants provided herein comprise an average height that is between 0.4 and 1.1 meters less or lower than the height (or average height) of at least one male inbred corn plant(s) (or the average plant height of male inbred corn plants) provided herein. In another aspect, the female inbred corn plants provided herein comprise an average height that is between 0.4 and 1.0 meters less or lower than the height (or average height) of at least one male inbred corn plant(s) (or the average plant height of male inbred corn plants) provided herein. In another aspect, the female inbred corn plants provided herein comprise an average height that is between 0.4 and 0.9 meters less or lower than the height (or average height) of at least one male inbred corn plant(s) (or the average plant height of male inbred corn plants) provided herein. In another aspect, the female inbred corn plants provided herein comprise an average height that is between 0.4 and 0.8 meters less or lower than the height (or average height) of at least one male inbred corn plant(s) (or the average plant height of male inbred corn plants) provided herein. In another aspect, the female inbred corn plants provided herein comprise an average height that is between 0.4 and 0.7 meters less or lower than the height (or average height) of at least one male inbred corn plant(s) (or the average plant height of male inbred corn plants) provided herein. In another aspect, the female inbred corn plants provided herein comprise an average height that is between 0.4 and 0.6 meters less or lower than the height (or average height) of at least one male inbred corn plant(s) (or the average plant height of male inbred corn plants) provided herein. In another aspect, the female inbred corn plants provided herein comprise an average height that is between 0.4 and 0.5 meters less or lower than the height (or average height) of at least one male inbred corn plant(s) (or the average plant height of male inbred corn plants) provided herein.

In another aspect, the female inbred corn plants provided herein comprise an average height that is between 0.5 and 2.0 meters less or lower than the height (or average height) of at least one male inbred corn plant(s) (or the average plant height of male inbred corn plants) provided herein. In another aspect, the female inbred corn plants provided herein comprise an average height that is between 0.5 and 1.9 meters less or lower than the height (or average height) of at least one male inbred corn plant(s) (or the average plant height of male inbred corn plants) provided herein. In another aspect, the female inbred corn plants provided herein comprise an average height that is between 0.5 and 1.8 meters less or lower than the height (or average height) of at least one male inbred corn plant(s) (or the average plant height of male inbred corn plants) provided herein. In another aspect, the female inbred corn plants provided herein comprise an average height that is between 0.5 and 1.7 meters less or lower than the height (or average height) of at least one male inbred corn plant(s) (or the average plant height of male inbred corn plants) provided herein. In another aspect, the female inbred corn plants provided herein comprise an average height that is between 0.5 and 1.6 meters less or lower than the height (or average height) of at least one male inbred corn plant(s) (or the average plant height of male inbred corn plants) provided herein. In another aspect, the female inbred corn plants provided herein comprise an average height that is between 0.5 and 1.5 meters less or lower than the height (or average height) of at least one male inbred corn plant(s) (or the average plant height of male inbred corn plants) provided herein. In another aspect, the female inbred corn plants provided herein comprise an average height that is between 0.5 and 1.4 meters less or lower than the height (or average height) of at least one male inbred corn plant(s) (or the average plant height of male inbred corn plants) provided herein. In another aspect, the female inbred corn plants provided herein comprise an average height that is between 0.5 and 1.3 meters less or lower than the height (or average height) of at least one male inbred corn plant(s) (or the average plant height of male inbred corn plants) provided herein. In another aspect, the female inbred corn plants provided herein comprise an average height that is between 0.5 and 1.2 meters less or lower than the height (or average height) of at least one male inbred corn plant(s) (or the average plant height of male inbred corn plants) provided herein. In another aspect, the female inbred corn plants provided herein comprise an average height that is between 0.5 and 1.1 meters less or lower than the height (or average height) of at least one male inbred corn plant(s) (or the average plant height of male inbred corn plants) provided herein. In another aspect, the female inbred corn plants provided herein comprise an average height that is between 0.5 and 1.0 meters less or lower than the height (or average height) of at least one male inbred corn plant(s) (or the average plant height of male inbred corn plants) provided herein. In another aspect, the female inbred corn plants provided herein comprise an average height that is between 0.5 and 0.9 meters less or lower than the height (or average height) of at least one male inbred corn plant(s) (or the average plant height of male inbred corn plants) provided herein. In another aspect, the female inbred corn plants provided herein comprise an average height that is between 0.5 and 0.8 meters less or lower than the height (or average height) of at least one male inbred corn plant(s) (or the average plant height of male inbred corn plants) provided herein. In another aspect, the female inbred corn plants provided herein comprise an average height that is between 0.5 and 0.7 meters less or lower than the height (or average height) of at least one male inbred corn plant(s) (or the average plant height of male inbred corn plants) provided herein. In another aspect, the female inbred corn plants provided herein comprise an average height that is between 0.5 and 0.6 meters less or lower than the height (or average height) of at least one male inbred corn plant(s) (or the average plant height of male inbred corn plants) provided herein.

In another aspect, the female inbred corn plants provided herein comprise an average height that is between 0.6 and 2.2 meters less or lower than the height (or average height) of at least one male inbred corn plant(s) (or the average plant height of male inbred corn plants) provided herein. In another aspect, the female inbred corn plants provided herein comprise an average height that is between 0.6 and 2.1 meters less or lower than the height (or average height) of at least one male inbred corn plant(s) (or the average plant height of male inbred corn plants) provided herein. In another aspect, the female inbred corn plants provided herein comprise an average height that is between 0.6 and 2.0 meters less or lower than the height (or average height) of at least one male inbred corn plant(s) (or the average plant height of male inbred corn plants) provided herein. In another aspect, the female inbred corn plants provided herein comprise an average height that is between 0.6 and 1.9 meters less or lower than the height (or average height) of at least one male inbred corn plant(s) (or the average plant height of male inbred corn plants) provided herein. In another aspect, the female inbred corn plants provided herein comprise an average height that is between 0.6 and 1.8 meters less or lower than the height (or average height) of at least one male inbred corn plant(s) (or the average plant height of male inbred corn plants) provided herein. In another aspect, the female inbred corn plants provided herein comprise an average height that is between 0.6 and 1.7 meters less or lower than the height (or average height) of at least one male inbred corn plant(s) (or the average plant height of male inbred corn plants) provided herein. In another aspect, the female inbred corn plants provided herein comprise an average height that is between 0.6 and 1.6 meters less or lower than the height (or average height) of at least one male inbred corn plant(s) (or the average plant height of male inbred corn plants) provided herein. In another aspect, the female inbred corn plants provided herein comprise an average height that is between 0.6 and 1.5 meters less or lower than the height (or average height) of at least one male inbred corn plant(s) (or the average plant height of male inbred corn plants) provided herein. In another aspect, the female inbred corn plants provided herein comprise an average height that is between 0.6 and 1.4 meters less or lower than the height (or average height) of at least one male inbred corn plant(s) (or the average plant height of male inbred corn plants) provided herein. In another aspect, the female inbred corn plants provided herein comprise an average height that is between 0.6 and 1.3 meters less or lower than the height (or average height) of at least one male inbred corn plant(s) (or the average plant height of male inbred corn plants) provided herein. In another aspect, the female inbred corn plants provided herein comprise an average height that is between 0.6 and 1.2 meters less or lower than the height (or average height) of at least one male inbred corn plant(s) (or the average plant height of male inbred corn plants) provided herein. In another aspect, the female inbred corn plants provided herein comprise an average height that is between 0.6 and 1.1 meters less or lower than the height (or average height) of at least one male inbred corn plant(s) (or the average plant height of male inbred corn plants) provided herein. In another aspect, the female inbred corn plants provided herein comprise an average height that is between 0.6 and 1.0 meters less or lower than the height (or average height) of at least one male inbred corn plant(s) (or the average plant height of male inbred corn plants) provided herein. In another aspect, the female inbred corn plants provided herein comprise an average height that is between 0.6 and 0.9 meters less or lower than the height (or average height) of at least one male inbred corn plant(s) (or the average plant height of male inbred corn plants) provided herein. In another aspect, the female inbred corn plants provided herein comprise an average height that is between 0.6 and 0.8 meters less or lower than the height (or average height) of at least one male inbred corn plant(s) (or the average plant height of male inbred corn plants) provided herein. In another aspect, the female inbred corn plants provided herein comprise an average height that is between 0.6 and 0.7 meters less or lower than the height (or average height) of at least one male inbred corn plant(s) (or the average plant height of male inbred corn plants) provided herein.

In another aspect, the female inbred corn plants provided herein comprise an average height that is between 0.7 and 2.2 meters less or lower than the height (or average height) of at least one male inbred corn plant(s) (or the average plant height of male inbred corn plants) provided herein. In another aspect, the female inbred corn plants provided herein comprise an average height that is between 0.7 and 2.1 meters less or lower than the height (or average height) of at least one male inbred corn plant(s) (or the average plant height of male inbred corn plants) provided herein. In another aspect, the female inbred corn plants provided herein comprise an average height that is between 0.7 and 2.0 meters less or lower than the height (or average height) of at least one male inbred corn plant(s) (or the average plant height of male inbred corn plants) provided herein. In another aspect, the female inbred corn plants provided herein comprise an average height that is between 0.7 and 1.9 meters less or lower than the height (or average height) of at least one male inbred corn plant(s) (or the average plant height of male inbred corn plants) provided herein. In another aspect, the female inbred corn plants provided herein comprise an average height that is between 0.7 and 1.8 meters less or lower than the height (or average height) of at least one male inbred corn plant(s) (or the average plant height of male inbred corn plants) provided herein. In another aspect, the female inbred corn plants provided herein comprise an average height that is between 0.7 and 1.7 meters less or lower than the height (or average height) of at least one male inbred corn plant(s) (or the average plant height of male inbred corn plants) provided herein. In another aspect, the female inbred corn plants provided herein comprise an average height that is between 0.7 and 1.6 meters less or lower than the height (or average height) of at least one male inbred corn plant(s) (or the average plant height of male inbred corn plants) provided herein. In another aspect, the female inbred corn plants provided herein comprise an average height that is between 0.7 and 1.5 meters less or lower than the height (or average height) of at least one male inbred corn plant(s) (or the average plant height of male inbred corn plants) provided herein. In another aspect, the female inbred corn plants provided herein comprise an average height that is between 0.7 and 1.4 meters less or lower than the height (or average height) of at least one male inbred corn plant(s) (or the average plant height of male inbred corn plants) provided herein. In another aspect, the female inbred corn plants provided herein comprise an average height that is between 0.7 and 1.3 meters less or lower than the height (or average height) of at least one male inbred corn plant(s) (or the average plant height of male inbred corn plants) provided herein. In another aspect, the female inbred corn plants provided herein comprise an average height that is between 0.7 and 1.2 meters less or lower than the height (or average height) of at least one male inbred corn plant(s) (or the average plant height of male inbred corn plants) provided herein. In another aspect, the female inbred corn plants provided herein comprise an average height that is between 0.7 and 1.1 meters less or lower than the height (or average height) of at least one male inbred corn plant(s) (or the average plant height of male inbred corn plants) provided herein. In another aspect, the female inbred corn plants provided herein comprise an average height that is between 0.7 and 1.0 meters less or lower than the height (or average height) of at least one male inbred corn plant(s) (or the average plant height of male inbred corn plants) provided herein. In another aspect, the female inbred corn plants provided herein comprise an average height that is between 0.7 and 0.9 meters less or lower than the height (or average height) of at least one male inbred corn plant(s) (or the average plant height of male inbred corn plants) provided herein. In another aspect, the female inbred corn plants provided herein comprise an average height that is between 0.7 and 0.8 meters less or lower than the height (or average height) of at least one male inbred corn plant(s) (or the average plant height of male inbred corn plants) provided herein.

In another aspect, the female inbred corn plants provided herein comprise an average height that is between 0.8 and 2.4 meters less or lower than the height (or average height) of at least one male inbred corn plant(s) (or the average plant height of male inbred corn plants) provided herein. In another aspect, the female inbred corn plants provided herein comprise an average height that is between 0.8 and 2.3 meters less or lower than the height (or average height) of at least one male inbred corn plant(s) (or the average plant height of male inbred corn plants) provided herein. In another aspect, the female inbred corn plants provided herein comprise an average height that is between 0.8 and 2.2 meters less or lower than the height (or average height) of at least one male inbred corn plant(s) (or the average plant height of male inbred corn plants) provided herein. In another aspect, the female inbred corn plants provided herein comprise an average height that is between 0.8 and 2.1 meters less or lower than the height (or average height) of at least one male inbred corn plant(s) (or the average plant height of male inbred corn plants) provided herein. In another aspect, the female inbred corn plants provided herein comprise an average height that is between 0.8 and 2.0 meters less or lower than the height (or average height) of at least one male inbred corn plant(s) (or the average plant height of male inbred corn plants) provided herein. In another aspect, the female inbred corn plants provided herein comprise an average height that is between 0.8 and 1.9 meters less or lower than the height (or average height) of at least one male inbred corn plant(s) (or the average plant height of male inbred corn plants) provided herein. In another aspect, the female inbred corn plants provided herein comprise an average height that is between 0.8 and 1.8 meters less or lower than the height (or average height) of at least one male inbred corn plant(s) (or the average plant height of male inbred corn plants) provided herein. In another aspect, the female inbred corn plants provided herein comprise an average height that is between 0.8 and 1.7 meters less or lower than the height (or average height) of at least one male inbred corn plant(s) (or the average plant height of male inbred corn plants) provided herein. In another aspect, the female inbred corn plants provided herein comprise an average height that is between 0.8 and 1.6 meters less or lower than the height (or average height) of at least one male inbred corn plant(s) (or the average plant height of male inbred corn plants) provided herein. In another aspect, the female inbred corn plants provided herein comprise an average height that is between 0.8 and 1.5 meters less or lower than the height (or average height) of at least one male inbred corn plant(s) (or the average plant height of male inbred corn plants) provided herein. In another aspect, the female inbred corn plants provided herein comprise an average height that is between 0.8 and 1.4 meters less or lower than the height (or average height) of at least one male inbred corn plant(s) (or the average plant height of male inbred corn plants) provided herein. In another aspect, the female inbred corn plants provided herein comprise an average height that is between 0.8 and 1.3 meters less or lower than the height (or average height) of at least one male inbred corn plant(s) (or the average plant height of male inbred corn plants) provided herein. In another aspect, the female inbred corn plants provided herein comprise an average height that is between 0.8 and 1.2 meters less or lower than the height (or average height) of at least one male inbred corn plant(s) (or the average plant height of male inbred corn plants) provided herein. In another aspect, the female inbred corn plants provided herein comprise an average height that is between 0.8 and 1.1 meters less or lower than the height (or average height) of at least one male inbred corn plant(s) (or the average plant height of male inbred corn plants) provided herein. In another aspect, the female inbred corn plants provided herein comprise an average height that is between 0.8 and 1.0 meters less or lower than the height (or average height) of at least one male inbred corn plant(s) (or the average plant height of male inbred corn plants) provided herein. In another aspect, the female inbred corn plants provided herein comprise an average height that is between 0.8 and 0.9 meters less or lower than the height of at least one male inbred corn plant (or the average plant height of male inbred corn plants) provided herein.

In another aspect, the female inbred corn plants provided herein comprise an average height that is between 0.9 and 2.4 meters less or lower than the height (or average height) of at least one male inbred corn plant(s) (or the average plant height of male inbred corn plants) provided herein. In another aspect, the female inbred corn plants provided herein comprise an average height that is between 0.9 and 2.3 meters less or lower than the height (or average height) of at least one male inbred corn plant(s) (or the average plant height of male inbred corn plants) provided herein. In another aspect, the female inbred corn plants provided herein comprise an average height that is between 0.9 and 2.2 meters less or lower than the height (or average height) of at least one male inbred corn plant(s) (or the average plant height of male inbred corn plants) provided herein. In another aspect, the female inbred corn plants provided herein comprise an average height that is between 0.9 and 2.1 meters less or lower than the height (or average height) of at least one male inbred corn plant(s) (or the average plant height of male inbred corn plants) provided herein. In another aspect, the female inbred corn plants provided herein comprise an average height that is between 0.9 and 2.0 meters less or lower than the height (or average height) of at least one male inbred corn plant(s) (or the average plant height of male inbred corn plants) provided herein. In another aspect, the female inbred corn plants provided herein comprise an average height that is between 0.9 and 1.9 meters less or lower than the height (or average height) of at least one male inbred corn plant(s) (or the average plant height of male inbred corn plants) provided herein. In another aspect, the female inbred corn plants provided herein comprise an average height that is between 0.9 and 1.8 meters less or lower than the height (or average height) of at least one male inbred corn plant(s) (or the average plant height of male inbred corn plants) provided herein. In another aspect, the female inbred corn plants provided herein comprise an average height that is between 0.9 and 1.7 meters less or lower than the height (or average height) of at least one male inbred corn plant(s) (or the average plant height of male inbred corn plants) provided herein. In another aspect, the female inbred corn plants provided herein comprise an average height that is between 0.9 and 1.6 meters less or lower than the height (or average height) of at least one male inbred corn plant(s) (or the average plant height of male inbred corn plants) provided herein. In another aspect, the female inbred corn plants provided herein comprise an average height that is between 0.9 and 1.5 meters less or lower than the height (or average height) of at least one male inbred corn plant(s) (or the average plant height of male inbred corn plants) provided herein. In another aspect, the female inbred corn plants provided herein comprise an average height that is between 0.9 and 1.4 meters less or lower than the height (or average height) of at least one male inbred corn plant(s) (or the average plant height of male inbred corn plants) provided herein. In another aspect, the female inbred corn plants provided herein comprise an average height that is between 0.9 and 1.3 meters less or lower than the height (or average height) of at least one male inbred corn plant(s) (or the average plant height of male inbred corn plants) provided herein. In another aspect, the female inbred corn plants provided herein comprise an average height that is between 0.9 and 1.2 meters less or lower than the height (or average height) of at least one male inbred corn plant(s) (or the average plant height of male inbred corn plants) provided herein. In another aspect, the female inbred corn plants provided herein comprise an average height that is between 0.9 and 1.1 meters less or lower than the height (or average height) of at least one male inbred corn plant(s) (or the average plant height of male inbred corn plants) provided herein. In another aspect, the female inbred corn plants provided herein comprise an average height that is between 0.9 and 1.0 meters less or lower than the height of at least one male inbred corn plant (or the average plant height of male inbred corn plants) provided herein.

In another aspect, the female inbred corn plants provided herein comprise an average height that is between 1.0 and 2.5 meters less or lower than the height (or average height) of at least one male inbred corn plant(s) (or the average plant height of male inbred corn plants) provided herein. In another aspect, the female inbred corn plants provided herein comprise an average height that is between 1.0 and 2.4 meters less or lower than the height (or average height) of at least one male inbred corn plant(s) (or the average plant height of male inbred corn plants) provided herein. In another aspect, the female inbred corn plants provided herein comprise an average height that is between 1.0 and 2.3 meters less or lower than the height (or average height) of at least one male inbred corn plant(s) (or the average plant height of male inbred corn plants) provided herein. In another aspect, the female inbred corn plants provided herein comprise an average height that is between 1.0 and 2.2 meters less or lower than the height (or average height) of at least one male inbred corn plant(s) (or the average plant height of male inbred corn plants) provided herein. In another aspect, the female inbred corn plants provided herein comprise an average height that is between 1.0 and 2.1 meters less or lower than the height (or average height) of at least one male inbred corn plant(s) (or the average plant height of male inbred corn plants) provided herein. In another aspect, the female inbred corn plants provided herein comprise an average height that is between 1.0 and 2.0 meters less or lower than the height (or average height) of at least one male inbred corn plant(s) (or the average plant height of male inbred corn plants) provided herein. In another aspect, the female inbred corn plants provided herein comprise an average height that is between 1.0 and 1.9 meters less or lower than the height (or average height) of at least one male inbred corn plant(s) (or the average plant height of male inbred corn plants) provided herein. In another aspect, the female inbred corn plants provided herein comprise an average height that is between 1.0 and 1.8 meters less or lower than the height (or average height) of at least one male inbred corn plant(s) (or the average plant height of male inbred corn plants) provided herein. In another aspect, the female inbred corn plants provided herein comprise an average height that is between 1.0 and 1.7 meters less or lower than the height (or average height) of at least one male inbred corn plant(s) (or the average plant height of male inbred corn plants) provided herein. In another aspect, the female inbred corn plants provided herein comprise an average height that is between 1.0 and 1.6 meters less or lower than the height (or average height) of at least one male inbred corn plant(s) (or the average plant height of male inbred corn plants) provided herein. In another aspect, the female inbred corn plants provided herein comprise an average height that is between 1.0 and 1.5 meters less or lower than the height (or average height) of at least one male inbred corn plant(s) (or the average plant height of male inbred corn plants) provided herein. In another aspect, the female inbred corn plants provided herein comprise an average height that is between 1.0 and 1.4 meters less or lower than the height (or average height) of at least one male inbred corn plant(s) (or the average plant height of male inbred corn plants) provided herein. In another aspect, the female inbred corn plants provided herein comprise an average height that is between 1.0 and 1.3 meters less or lower than the height (or average height) of at least one male inbred corn plant(s) (or the average plant height of male inbred corn plants) provided herein. In another aspect, the female inbred corn plants provided herein comprise an average height that is between 1.0 and 1.2 meters less or lower than the height (or average height) of at least one male inbred corn plant(s) (or the average plant height of male inbred corn plants) provided herein. In another aspect, the female inbred corn plants provided herein comprise an average height that is between 1.0 and 1.1 meters less or lower than the height (or average height) of at least one male inbred corn plant(s) (or the average plant height of male inbred corn plants) provided herein.

In another aspect, the female inbred corn plants provided herein comprise an average height that is between 1.2 and 2.5 meters less or lower than the height (or average height) of at least one male inbred corn plant(s) (or the average plant height of male inbred corn plants) provided herein. In another aspect, the female inbred corn plants provided herein comprise an average height that is between 1.2 and 2.4 meters less or lower than the height (or average height) of at least one male inbred corn plant(s) (or the average plant height of male inbred corn plants) provided herein. In another aspect, the female inbred corn plants provided herein comprise an average height that is between 1.2 and 2.3 meters less or lower than the height (or average height) of at least one male inbred corn plant(s) (or the average plant height of male inbred corn plants) provided herein. In another aspect, the female inbred corn plants provided herein comprise an average height that is between 1.2 and 2.2 meters less or lower than the height (or average height) of at least one male inbred corn plant(s) (or the average plant height of male inbred corn plants) provided herein. In another aspect, the female inbred corn plants provided herein comprise an average height that is between 1.2 and 2.1 meters less or lower than the height (or average height) of at least one male inbred corn plant(s) (or the average plant height of male inbred corn plants) provided herein. In another aspect, the female inbred corn plants provided herein comprise an average height that is between 1.2 and 2.0 meters less or lower than the height (or average height) of at least one male inbred corn plant(s) (or the average plant height of male inbred corn plants) provided herein. In another aspect, the female inbred corn plants provided herein comprise an average height that is between 1.2 and 1.9 meters less or lower than the height (or average height) of at least one male inbred corn plant(s) (or the average plant height of male inbred corn plants) provided herein. In another aspect, the female inbred corn plants provided herein comprise an average height that is between 1.2 and 1.8 meters less or lower than the height (or average height) of at least one male inbred corn plant(s) (or the average plant height of male inbred corn plants) provided herein. In another aspect, the female inbred corn plants provided herein comprise an average height that is between 1.2 and 1.7 meters less or lower than the height (or average height) of at least one male inbred corn plant(s) (or the average plant height of male inbred corn plants) provided herein. In another aspect, the female inbred corn plants provided herein comprise an average height that is between 1.2 and 1.6 meters less or lower than the height (or average height) of at least one male inbred corn plant(s) (or the average plant height of male inbred corn plants) provided herein. In another aspect, the female inbred corn plants provided herein comprise an average height that is between 1.2 and 1.5 meters less or lower than the height (or average height) of at least one male inbred corn plant(s) (or the average plant height of male inbred corn plants) provided herein. In another aspect, the female inbred corn plants provided herein comprise an average height that is between 1.2 and 1.4 meters less or lower than the height (or average height) of at least one male inbred corn plant(s) (or the average plant height of male inbred corn plants) provided herein. In another aspect, the female inbred corn plants provided herein comprise an average height that is between 1.2 and 1.3 meters less or lower than the height (or average height) of at least one male inbred corn plant(s) (or the average plant height of male inbred corn plants) provided herein.

In another aspect, the female inbred corn plants provided herein comprise an average height that is between 1.4 and 2.5 meters less or lower than the height (or average height) of at least one male inbred corn plant(s) (or the average plant height of male inbred corn plants) provided herein. In another aspect, the female inbred corn plants provided herein comprise an average height that is between 1.4 and 2.4 meters less or lower than the height (or average height) of at least one male inbred corn plant(s) (or the average plant height of male inbred corn plants) provided herein. In another aspect, the female inbred corn plants provided herein comprise an average height that is between 1.4 and 2.3 meters less or lower than the height (or average height) of at least one male inbred corn plant(s) (or the average plant height of male inbred corn plants) provided herein. In another aspect, the female inbred corn plants provided herein comprise an average height that is between 1.4 and 2.2 meters less or lower than the height (or average height) of at least one male inbred corn plant(s) (or the average plant height of male inbred corn plants) provided herein. In another aspect, the female inbred corn plants provided herein comprise an average height that is between 1.4 and 2.1 meters less or lower than the height (or average height) of at least one male inbred corn plant(s) (or the average plant height of male inbred corn plants) provided herein. In another aspect, the female inbred corn plants provided herein comprise an average height that is between 1.4 and 2.0 meters less or lower than the height (or average height) of at least one male inbred corn plant(s) (or the average plant height of male inbred corn plants) provided herein. In another aspect, the female inbred corn plants provided herein comprise an average height that is between 1.4 and 1.9 meters less or lower than the height (or average height) of at least one male inbred corn plant(s) (or the average plant height of male inbred corn plants) provided herein. In another aspect, the female inbred corn plants provided herein comprise an average height that is between 1.4 and 1.8 meters less or lower than the height (or average height) of at least one male inbred corn plant(s) (or the average plant height of male inbred corn plants) provided herein. In another aspect, the female inbred corn plants provided herein comprise an average height that is between 1.4 and 1.7 meters less or lower than the height (or average height) of at least one male inbred corn plant(s) (or the average plant height of male inbred corn plants) provided herein. In another aspect, the female inbred corn plants provided herein comprise an average height that is between 1.4 and 1.6 meters less or lower than the height (or average height) of at least one male inbred corn plant(s) (or the average plant height of male inbred corn plants) provided herein. In another aspect, the female inbred corn plants provided herein comprise an average height that is between 1.4 and 1.5 meters less or lower than the height (or average height) of at least one male inbred corn plant(s) (or the average plant height of male inbred corn plants) provided herein.

In another aspect, the female inbred corn plants provided herein comprise an average height that is between 1.6 and 2.5 meters less or lower than the height (or average height) of at least one male inbred corn plant(s) (or the average plant height of male inbred corn plants) provided herein. In another aspect, the female inbred corn plants provided herein comprise an average height that is between 1.6 and 2.4 meters less or lower than the height (or average height) of at least one male inbred corn plant(s) (or the average plant height of male inbred corn plants) provided herein. In another aspect, the female inbred corn plants provided herein comprise an average height that is between 1.6 and 2.3 meters less or lower than the height (or average height) of at least one male inbred corn plant(s) (or the average plant height of male inbred corn plants) provided herein. In another aspect, the female inbred corn plants provided herein comprise an average height that is between 1.6 and 2.2 meters less or lower than the height (or average height) of at least one male inbred corn plant(s) (or the average plant height of male inbred corn plants) provided herein. In another aspect, the female inbred corn plants provided herein comprise an average height that is between 1.6 and 2.1 meters less or lower than the height (or average height) of at least one male inbred corn plant(s) (or the average plant height of male inbred corn plants) provided herein. In another aspect, the female inbred corn plants provided herein comprise an average height that is between 1.6 and 2.0 meters less or lower than the height (or average height) of at least one male inbred corn plant(s) (or the average plant height of male inbred corn plants) provided herein. In another aspect, the female inbred corn plants provided herein comprise an average height that is between 1.6 and 1.9 meters less or lower than the height (or average height) of at least one male inbred corn plant(s) (or the average plant height of male inbred corn plants) provided herein. In another aspect, the female inbred corn plants provided herein comprise an average height that is between 1.6 and 1.8 meters less or lower than the height of at least one male inbred corn plant (or the average plant height of male inbred corn plants) provided herein.

In another aspect, the female inbred corn plants provided herein comprise an average height that is between 1.8 and 2.5 meters less or lower than the height (or average height) of at least one male inbred corn plant(s) (or the average plant height of male inbred corn plants) provided herein. In another aspect, the female inbred corn plants provided herein comprise an average height that is between 1.8 and 2.4 meters less or lower than the height (or average height) of at least one male inbred corn plant(s) (or the average plant height of male inbred corn plants) provided herein. In another aspect, the female inbred corn plants provided herein comprise an average height that is between 1.8 and 2.3 meters less or lower than the height (or average height) of at least one male inbred corn plant(s) (or the average plant height of male inbred corn plants) provided herein. In another aspect, the female inbred corn plants provided herein comprise an average height that is between 1.8 and 2.2 meters less or lower than the height (or average height) of at least one male inbred corn plant(s) (or the average plant height of male inbred corn plants) provided herein. In another aspect, the female inbred corn plants provided herein comprise an average height that is between 1.8 and 2.1 meters less or lower than the height (or average height) of at least one male inbred corn plant(s) (or the average plant height of male inbred corn plants) provided herein. In another aspect, the female inbred corn plants provided herein comprise an average height that is between 1.8 and 2.0 meters less or lower than the height of at least one male inbred corn plant (or the average plant height of male inbred corn plants) provided herein.

In an aspect, a female corn plant provided herein comprises one or more ears at least 14 inches above ground level. In another aspect, a female corn plant provided herein comprises one or more ears at least 15 inches above ground level. In another aspect, a female corn plant provided herein comprises one or more ears at least 16 inches above ground level. In another aspect, a female corn plant provided herein comprises one or more ears at least 17 inches above ground level. In another aspect, a female corn plant provided herein comprises one or more ears at least 18 inches above ground level. In another aspect, a female corn plant provided herein comprises one or more ears at least 19 inches above ground level. In another aspect, a female corn plant provided herein comprises one or more ears at least 20 inches above ground level. In another aspect, a female corn plant provided herein comprises one or more ears at least 21 inches above ground level. In another aspect, a female corn plant provided herein comprises one or more ears at least 22 inches above ground level. In another aspect, a female corn plant provided herein comprises one or more ears at least 23 inches above ground level. In another aspect, a female corn plant provided herein comprises one or more ears at least 24 inches above ground level. In another aspect, a female corn plant provided herein comprises one or more ears at least 25 inches above ground level. In another aspect, a female corn plant provided herein comprises one or more ears at least 26 inches above ground level. In another aspect, a female corn plant provided herein comprises one or more ears at least 27 inches above ground level. In another aspect, a female corn plant provided herein comprises one or more ears at least 28 inches above ground level. In another aspect, a female corn plant provided herein comprises one or more ears at least 29 inches above ground level. In another aspect, a female corn plant provided herein comprises one or more ears at least 30 inches above ground level.

According to embodiments of the present disclosure, corn ear heights or average corn ear height of (or on) female corn plants as described herein (e.g., in a corn production field) may be at or during a late vegetative and/or a reproductive stage of development when tassel formation and extension, pollen shed, silking, pollination, and/or kernel or ear development occurs, such as V12, V13, V14, V15, Vn, VT, R1, R2, R3, R4, R5, and/or R6 stage, such as VT or R1 stage. If the developmental stage is not specified or stated, then the corn ear height(s) and/or average corn ear height(s) of (or on) female corn plants as described herein is at R1 stage.

In an aspect, at least one female corn plant provided herein comprises at least one ear or an average ear height that is at least 14 inches above ground level. In another aspect, at least one female corn plant provided herein comprises at least one ear or an average ear height that is at least 15 inches above ground level. In another aspect, at least one female corn plant provided herein comprises at least one ear that is at least 16 inches above ground level. In another aspect, at least one female corn plant provided herein comprises at least one ear or an average ear height that is at least 17 inches above ground level. In another aspect, at least one female corn plant provided herein comprises at least one ear that is at least 18 inches above ground level. In another aspect, at least one female corn plant provided herein comprises at least one ear or an average ear height that is at least 19 inches above ground level. In another aspect, at least one female corn plant provided herein comprises at least one ear that is at least 20 inches above ground level. In another aspect, at least one female corn plant provided herein comprises at least one ear or an average ear height that is at least 21 inches above ground level. In another aspect, at least one female corn plant provided herein comprises at least one ear or an average ear height that is at least 22 inches above ground level. In another aspect, at least one female corn plant provided herein comprises at least one ear that is at least 23 inches above ground level. In another aspect, at least one female corn plant provided herein comprises at least one ear or an average ear height that is at least 24 inches above ground level. In another aspect, at least one female corn plant provided herein comprises at least one ear or an average ear height that is at least 25 inches above ground level. In another aspect, at least one female corn plant provided herein comprises at least one ear or an average ear height that is at least 26 inches above ground level. In another aspect, at least one female corn plant provided herein comprises at least one ear or an average ear height that is at least 27 inches above ground level. In another aspect, at least one female corn plant provided herein comprises at least one ear or an average ear height that is at least 28 inches above ground level. In another aspect, at least one female corn plant provided herein comprises at least one ear or an average ear height that is at least 29 inches above ground level. In another aspect, at least one female corn plant provided herein comprises at least one ear or an average ear height that is at least 30 inches above ground level.

In an aspect, at least one female corn plant provided herein comprises at least one ear or an average ear height between 14 and 40 inches above ground level. In an aspect, at least one female corn plant provided herein comprises at least one ear or an average ear height between 14 and 35 inches above ground level. In an aspect, at least one female corn plant provided herein comprises at least one ear or an average ear height between 14 and 30 inches above ground level. In an aspect, at least one female corn plant provided herein comprises at least one ear or an average ear height between 14 and 25 inches above ground level. In an aspect, at least one female corn plant provided herein comprises at least one ear or an average ear height between 14 and 20 inches above ground level. In an aspect, at least one female corn plant provided herein comprises at least one ear or an average ear height between 14 and 18 inches above ground level. In an aspect, at least one female corn plant provided herein comprises at least one ear or an average ear height between 14 and 16 inches above ground level.

In an aspect, at least one female corn plant provided herein comprises at least one ear or an average ear height between 16 and 40 inches above ground level. In an aspect, at least one female corn plant provided herein comprises at least one ear or an average ear height between 16 and 35 inches above ground level. In an aspect, at least one female corn plant provided herein comprises at least one ear or an average ear height between 16 and 30 inches above ground level. In an aspect, at least one female corn plant provided herein comprises at least one ear or an average ear height between 16 and 25 inches above ground level. In an aspect, at least one female corn plant provided herein comprises at least one ear or an average ear height between 16 and 20 inches above ground level. In another aspect, at least one female corn plant provided herein comprises at least one ear or an average ear height between 16 and 18 inches above ground level.

In an aspect, at least one female corn plant provided herein comprises at least one ear or an average ear height between 18 and 40 inches above ground level. In an aspect, at least one female corn plant provided herein comprises at least one ear or an average ear height between 18 and 35 inches above ground level. In an aspect, at least one female corn plant provided herein comprises at least one ear or an average ear height between 18 and 30 inches above ground level. In an aspect, at least one female corn plant provided herein comprises at least one ear or an average ear height between 18 and 25 inches above ground level. In an aspect, at least one female corn plant provided herein comprises at least one ear or an average ear height between 18 and 22 inches above ground level. In another aspect, at least one female corn plant provided herein comprises at least one ear or an average ear height between 18 and 20 inches above ground level.

In an aspect, at least one female corn plant provided herein comprises at least one ear or an average ear height between 20 and 40 inches above ground level. In an aspect, at least one female corn plant provided herein comprises at least one ear or an average ear height between 20 and 35 inches above ground level. In an aspect, at least one female corn plant provided herein comprises at least one ear or an average ear height between 20 and 30 inches above ground level. In an aspect, at least one female corn plant provided herein comprises at least one ear or an average ear height between 20 and 25 inches above ground level. In another aspect, at least one female corn plant provided herein comprises at least one ear or an average ear height between 20 and 22 inches above ground level.

The description above for a female corn plant having at least one ear at or above a height, or within a height range, can also be applied to a plurality, row(s) or population of female corn plants used for seed production.

As used herein, the term "pollination" refers to the transfer of pollen from a male corn plant, or male floret, to a receptive structure of a female corn plant, or female floret. An example of a receptive structure of a female corn plant is a silk. It is appreciated in the art that a corn plant can pollinate itself (e.g., it is capable of self-pollination) if not detasseled, etc. In an aspect, a corn plant provided herein is not capable of self-pollination.

As used herein, the term "fertilization" refers to the union of a male gamete and a female gamete to produce a kernel, or fertilized egg, following pollination. In an aspect, fertilization is performed by wind. In another aspect, fertilization is performed by human intervention. In another aspect, fertilization is performed by an animal or insect.

As used herein, the term "crossing" refers to the deliberate mating of two plants. The two types of plants can be distantly related, closely related, or identical. In an aspect, crossing comprises pollination and/or fertilization of a plurality or population of female inbred corn plants with pollen from at least one male inbred corn plant. In another aspect, crossing comprises pollination and/or fertilization of a plurality or population of female corn plants with pollen from at least one male corn plant. In another aspect, crossing comprises pollination and/or fertilization of a female corn plant or inbred with pollen from at least one male corn plant.

Crosses can be set up to produce desired genotypes in progeny seed. If a specific trait is desired in the progeny of a cross, different parental zygosities can be used for recessive and dominant or semi-dominant single-gene traits or transgenes.

For example, without being limiting, a female plant homozygous for a dominant or semi-dominant mutant allele or transgene can be crossed to a wildtype male plant. According to Mendelian inheritance, all progeny produced by such a cross will be heterozygous or hemizygous for the dominant or semi-dominant mutant allele or transgene and will thus display a phenotype conferred by the dominant or semi-dominant mutant allele or transgene.

As another non-limiting example, a female plant heterozygous for a dominant or semi-dominant mutant allele or transgene can be crossed to a wildtype male plant. With this cross accordingly to Mendelian inheritance, approximately 50% of the progeny would be expected to be heterozygous or hemizygous for the dominant or semi-dominant mutant allele or transgene, and approximately 50% of the progeny would be expected to be wildtype. If the dominant or semi-dominant mutant allele or transgene confers a short stature phenotype, this type of cross would enable the co-production of short stature corn plants and normal (taller) stature corn plants having the same isoline or genetic background. With this approach, a selectable or screenable marker may be used to select or sort progeny plants or seeds that are wild type or heterozygous or hemizygous for the dominant or semi-dominant mutant allele or transgene. The female parent plant may have the selectable or screenable marker or molecularly assayable genotype within a corresponding (e.g., genetically linked) region or locus on the opposing chromosome relative to the dominant or semi-dominant mutant allele or transgene, such that the selectable or screenable marker or molecularly assayable genotype will segregate away from the dominant or semi-dominant mutant allele or transgene in progeny plants or seeds and can thus be used to select for progeny plants or seeds that are wild type or heterozygous or hemizygous for the dominant or semi-dominant mutant allele or transgene based on presence or absence of the selectable or screenable marker or molecularly assayable genotype.

As an alternative approach, the female parent plant may have the selectable or screenable marker or molecularly assayable genotype within the same (e.g., genetically linked) region or locus on the same chromosome as the dominant or semi-dominant mutant allele or transgene, such that the selectable or screenable marker or molecularly assayable genotype will segregate with the dominant or semi-dominant mutant allele or transgene in progeny plants or seeds and can thus be used to select for progeny plants or seeds that are wild type or heterozygous or hemizygous for the dominant or semi-dominant mutant allele or transgene based on presence or absence of the selectable or screenable marker or molecularly assayable genotype.

As another non-limiting example, if a short stature trait is conferred by a recessive mutant allele(s), the trait can be observed in approximately 50% of the progeny of a cross between a female plant that is homozygous or biallelic for the recessive allele(s) and a male plant that is heterozygous for a recessive allele. Alternatively, a cross between a female plant that is heterozygous for a recessive allele and a male plant that is heterozygous for the same or different recessive allele could allow for the short stature trait to be observed in approximately 25% of the progeny. These two types of crosses could also enable the co-production of short stature corn plants and normal stature corn plants having the same isoline or genetic background. With these approaches, a selectable or screenable marker may be used to select or sort progeny plants or seeds that are wild type, heterozygous or homozygous (or biallelic) for the recessive mutant allele. The male parent plant may have the selectable or screenable marker or molecularly assayable genotype within a corresponding (e.g., genetically linked) region or locus on the opposing chromosome relative to the recessive mutant allele, such that the selectable or screenable marker or molecularly assayable genotype will segregate away from the recessive mutant allele in progeny plants or seeds and can thus be used to select for progeny plants or seeds that are wild type, heterozygous or homozygous for the recessive mutant allele (depending on whether the female parent is homozygous or heterozygous for a recessive allele) based on presence or absence (and copy number) of the selectable or screenable marker or molecularly assayable genotype. As an alternative approach, the male parent plant may have the selectable or screenable marker or molecularly assayable genotype within the same (e.g., genetically linked) region or locus on the same chromosome as the recessive mutant allele, such that the selectable or screenable marker or molecularly assayable genotype will segregate with the recessive mutant allele in progeny plants or seeds and can thus be used to select for progeny plants or seeds that are wild type. heterozygous or homozygous for the recessive mutant allele (depending on whether the female parent is homozygous or heterozygous for a recessive allele) based on presence or absence (and copy number) of the selectable or screenable marker or molecularly assayable genotype.

In an aspect, progeny plants or seeds that are wild type or heterozygous or hemizygous for a dominant or semi-dominant mutant allele or transgene may be selected based on the presence or absence of a molecularly assayable genotype corresponding to the wild type or dominant or semi-dominant mutant allele or transgene. In an aspect, progeny plants or seeds that are wild type, heterozygous or homozygous for a recessive mutant allele may be selected based on presence or absence of a molecularly assayable genotype corresponding to the wild type or recessive mutant allele.

As used herein, a male corn plant and a female corn plant are in “proximity” or “near” to one other if they are physically separated by a distance short enough to allow cross-pollination to occur.

As used herein, a “hybrid corn seed” is considered to be a seed which is produced by the fertilization of a female corn plant of a first variety, line, or cultivar with the pollen of a male corn plant of a different variety, line, or cultivar (i.e., a seed produced by a hybrid corn plant).

As used herein, a “field” or a “corn field” refers to an outdoor location that is suitable for growing corn. The location can be irrigated or non-irrigated. A corn field can comprise a land area planted with corn seed and/or at least one corn plant or a plurality of corn plants, which can be at one or more stages of development. In an aspect, a corn plant provided herein is planted in a field. In another aspect, a corn plant provided herein is planted indoors, such as in a greenhouse, and/or in a container holding a growth medium or soil.

In an aspect, a field comprises a single plot. In another aspect, a field comprises multiple plots. In another aspect, one or more edges of a field are bordered by a fence. In another aspect, one or more edges of a field are unfenced. In another aspect, one or more edges of a field are bordered by hedges. In an aspect, a field comprises a physically contiguous space. In another aspect, the field comprises a physically non-contiguous space. In still another aspect, the field comprises a biologically contiguous space. As used herein, a “biologically contiguous space” refers to a space or field wherein the pollen can move from one section of the space or field to another section of the space or field. In an aspect, a biologically contiguous field is physically contiguous. In another aspect, a biologically contiguous field is physically non-contiguous (e.g., plots within the field or a single plot within the field can be separated by one or more structures, such as, without being limiting, a road, creek, irrigation ditch, trail, hedgerow, fence, irrigation pipes, fallow field, empty field, non-corn plants).

In an aspect, a field comprises at least 0.5 acres. In an aspect, a field comprises at least 1 acre. In another aspect, a field comprises at least 5 acres. In another aspect, a field comprises at least 10 acres. In another aspect, a field comprises at least 15 acres. In another aspect, a field comprises at least 20 acres. In another aspect, a field comprises at least 25 acres. In another aspect, a field comprises at least 30 acres. In another aspect, a field comprises at least 35 acres. In another aspect, a field comprises at least 40 acres. In another aspect, a field comprises at least 45 acres. In another aspect, a field comprises at least 50 acres. In another aspect, a field comprises at least 75 acres. In another aspect, a field comprises at least 100 acres. In another aspect, a field comprises at least 150 acres. In another aspect, a field comprises at least 200 acres. In another aspect, a field comprises at least 250 acres. In another aspect, a field comprises at least 300 acres. In another aspect, a field comprises at least 350 acres. In another aspect, a field comprises at least 400 acres. In another aspect, a field comprises at least 450 acres. In another aspect, a field comprises at least 500 acres. In another aspect, a field comprises at least 750 acres. In another aspect, a field comprises at least 1000 acres. In another aspect, a field comprises at least 1500 acres. In another aspect, a field comprises at least 2000 acres. In another aspect, a field comprises at least 2500 acres. In another aspect, a field comprises at least 3000 acres. In another aspect, a field comprises at least 4000 acres. In another aspect, a field comprises at least 5000 acres. In another aspect, a field comprises at least 10,000 acres.

In an aspect, a field comprises between 0.5 acres and 10,000 acres. In another aspect, a field comprises between 1 acre and 10,000 acres. In another aspect, a field comprises between 5 acres and 10,000 acres. In another aspect, a field comprises between 10 acres and 10,000 acres. In another aspect, a field comprises between 15 acres and 10,000 acres. In another aspect, a field comprises between 20 acres and 10,000 acres. In another aspect, a field comprises between 25 acres and 10,000 acres. In another aspect, a field comprises between 30 acres and 10,000 acres. In another aspect, a field comprises between 35 acres and 10,000 acres. In another aspect, a field comprises between 40 acres and 10,000 acres. In another aspect, a field comprises between 45 acres and 10,000 acres. In another aspect, a field comprises between 50 acres and 10,000 acres. In another aspect, a field comprises between 75 acres and 10,000 acres. In another aspect, a field comprises between 100 acres and 10,000 acres. In another aspect, a field comprises between 150 acres and 10,000 acres. In another aspect, a field comprises between 200 acres and 10,000 acres. In another aspect, a field comprises between 250 acres and 10,000 acres. In another aspect, a field comprises between 300 acres and 10,000 acres. In another aspect, a field comprises between 350 acres and 10,000 acres. In another aspect, a field comprises between 400 acres and 10,000 acres. In another aspect, a field comprises between 450 acres and 10,000 acres. In another aspect, a field comprises between 500 acres and 10,000 acres. In another aspect, a field comprises between 750 acres and 10,000 acres. In another aspect, a field comprises between 1000 acres and 10,000 acres. In another aspect, a field comprises between 1500 acres and 10,000 acres. In another aspect, a field comprises between 2000 acres and 10,000 acres. In another aspect, a field comprises between 2500 acres and 10,000 acres. In another aspect, a field comprises between 3000 acres and 10,000 acres. In another aspect, a field comprises between 4000 acres and 10,000 acres. In another aspect, a field comprises between 5000 acres and 10,000 acres. In another aspect, a field comprises between 1 acre and 5000 acres. In another aspect, a field comprises between 1 acre and 2500 acres. In another aspect, a field comprises between 1 acre and 1000 acres. In another aspect, a field comprises between 1 acre and 500 acres. In another aspect, a field comprises between 1 acre and 250 acres. In another aspect, a field comprises between 1 acre and 100 acres. In another aspect, a field comprises between 1 acre and 75 acres. In another aspect, a field comprises between 1 acre and 50 acres. In another aspect, a field comprises between 1 acre and 25 acres. In another aspect, a field comprises between 1 acre and 10 acres.

In an aspect, the corn plants provided herein are grown in a field. According to aspects of the present disclosure, a field may comprise male and female corn plants of different inbreds or varieties for hybrid corn seed production. In another aspect, the female inbred corn plants and at least one male inbred corn plant provided herein are grown in a field. In another aspect, the corn plants provided herein are grown in a greenhouse. In another aspect, the female inbred corn plants and at least one male inbred corn plant provided herein are grown in a greenhouse. According to some aspects, a corn field can comprise two or more pluralities of corn plants with the pluralities of corn plants being planted with different corn varieties, at different times, at different densities, in different arrangements (e.g., in rows or scattered or random placement), and/or at different row spacings and/or row lengths, such that the pluralities of corn plants have different heights, spacings, etc., at different time points during the growing season, although each plurality of corn plants can be relatively uniform with respect to plant height and other growth metrics. Typically, corn plants are planted in rows of approximately equal spacing, which may comprise male and female rows for corn seed production. The female and male rows may be present in a regular or repeating pattern or in an irregular or non-repeating pattern, and/or male plants may be interplanted between female rows. As yet another alternative, the female and male plants may be planted randomly or not in rows.

In an aspect, a corn field can further comprise plants other than corn plants including, without being limiting, cotton, alfalfa, sunflowers, sorghum, wheat, barley, oat, rice, rye, soybean, vegetables (e.g., potato, tomato, carrot), grass (e.g., bluegrass, Triticale), and weeds. In another aspect, a greenhouse and/or in a container holding a growth medium or soil can further comprise plants other than corn plants including, without being limiting, cotton, alfalfa, sunflowers, sorghum, wheat, barley, oat, rice, rye, soybean, vegetables (e.g., potato, tomato, carrot), grass (e.g., bluegrass, Triticale), and weeds.

In an aspect, a corn field comprises at least two corn plants. In another aspect, a corn field comprises at least 10 corn plants. In another aspect, a corn field comprises at least 100 corn plants. In another aspect, a corn field comprises at least 200 corn plants. In another aspect, a corn field comprises at least 500 corn plants. In another aspect, a corn field comprises at least 1,000 corn plants. In another aspect, a corn field comprises at least 2,000 corn plants. In another aspect, a corn field comprises at least 5,000 corn plants. In another aspect, a corn field comprises at least 10,000 corn plants. In another aspect, a corn field comprises at least 20,000 corn plants. In another aspect, a corn field comprises at least 50,000 corn plants. In another aspect, a corn field comprises at least 100,000 corn plants. In another aspect, a corn field comprises at least 200,000 corn plants. In another aspect, a corn field comprises at least 500,000 corn plants. In another aspect, a corn field comprises at least 1,000,000 corn plants. In another aspect, a corn field comprises at least 2,000,000 corn plants. In another aspect, a corn field comprises at least 5,000,000 corn plants. In another aspect, a corn field comprises at least 10,000,000 corn plants.

In an aspect, a corn field comprises between 1 and 10 corn plants. In another aspect, a corn field comprises between 1 and 100 corn plants. In another aspect, a corn field comprises between 1 and 200 corn plants. In another aspect, a corn field comprises between 1 and 500 corn plants. In another aspect, a corn field comprises between 1 and 1,000 corn plants. In another aspect, a corn field comprises between 1 and 2,000 corn plants. In another aspect, a corn field comprises between 1 and 5,000 corn plants. In another aspect, a corn field comprises between 1 and 10,000 corn plants. In another aspect, a corn field comprises between 1 and 20,000 corn plants. In another aspect, a corn field comprises between 1 and 50,000 corn plants. In another aspect, a corn field comprises between 1 and 100,000 corn plants. In another aspect, a corn field comprises between 1 and 200,000 corn plants. In another aspect, a corn field comprises between 1 and 500,000 corn plants. In another aspect, a corn field comprises between 1 and 1,000,000 corn plants. In another aspect, a corn field comprises between 1 and 2,000,000 corn plants. In another aspect, a corn field comprises between 1 and 5,000,000 corn plants. In another aspect, a corn field comprises between 1 and 10,000,000 corn plants. In another aspect, a corn field comprises between 10 and 10,000,000 corn plants. In another aspect, a corn field comprises between 100 and 10,000,000 corn plants. In another aspect, a corn field comprises between 200 and 10,000,000 corn plants. In another aspect, a corn field comprises between 500 and 10,000,000 corn plants. In another aspect, a corn field comprises between 1,000 and 10,000,000 corn plants. In another aspect, a corn field comprises between 2,000 and 10,000,000 corn plants. In another aspect, a corn field comprises between 5,000 and 10,000,000 corn plants. In another aspect, a corn field comprises between 10,000 and 10,000,000 corn plants. In another aspect, a corn field comprises between 20,000 and 10,000,000 corn plants. In another aspect, a corn field comprises between 50,000 and 10,000,000 corn plants. In another aspect, a corn field comprises between 100,000 and 10,000,000 corn plants. In another aspect, a corn field comprises between 200,000 and 10,000,000 corn plants. In another aspect, a corn field comprises between 500,000 and 10,000,000 corn plants. In another aspect, a corn field comprises between 1,000,000 and 10,000,000 corn plants. In another aspect, a corn field comprises between 2,000,000 and 10,000,000 corn plants. In another aspect, a corn field comprises between 5,000,000 and 10,000,000 corn plants. In another aspect, a corn field comprises between 1,000 and 10,000 corn plants. In another aspect, a corn field comprises between 1,000 and 100,000 corn plants. In another aspect, a corn field comprises between 10,000 and 50,000 corn plants. In another aspect, a corn field comprises between 10,000 and 100,000 corn plants. In another aspect, a corn field comprises between 10,000 and 1,000,000 corn plants. In another aspect, a corn field comprises between 100,000 and 1,000,000 corn plants. In another aspect, a corn field comprises between 100,000 and 2,000,000 corn plants. In another aspect, a corn field comprises between 100,000 and 5,000,000 corn plants. In another aspect, a corn field comprises between 1,000,000 and 2,000,000 corn plants. In another aspect, a corn field comprises between 1,000,000 and 5,000,000 corn plants. In another aspect, a corn field comprises between 2,000,000 and 5,000,000 corn plants.

As used herein, a "row" comprises at least one corn plant. In an aspect, a row comprises at least two corn plants. Without being limiting, a row of corn plants is planted in a line or in a generally or approximately linear arrangement, and if a corn field comprises two or more rows, they are typically planted parallel or nearly parallel to each other. A corn field can comprise one or more rows of corn plants where the rows are of the same or different lengths. Without being limiting, a corn field can comprise at least 1 row of corn plants. In another aspect, a corn field comprises at least 10 rows of corn plants. In another aspect, a corn field comprises at least 50 rows of corn plants. In another aspect, a corn field comprises at least 500 rows of corn plants. In another aspect, a corn field comprises at least 1,000 rows of corn plants. In another aspect, a corn field comprises at least 5,000 rows of corn plants. In another aspect, a corn field comprises at least 10,000 rows of corn plants.

In an aspect, a corn field comprises rows that are spaced at least 5 inches apart. In another aspect, a corn field comprises rows that are spaced at least 10 inches apart. In another aspect, a corn field comprises rows that are spaced at least 15 inches apart. In another aspect, a corn field comprises rows of corn plants that are spaced at least 20 inches apart. In another aspect, a corn field comprises rows of corn that are spaced at least 25 inches apart. In another aspect, a corn field comprises rows of corn that are spaced at least 30 inches apart. In another aspect, a corn field comprises rows of corn that are spaced at least 35 inches apart. In another aspect, a corn field comprises rows of corn that are spaced at least 40 inches apart.

As used herein, the term "density" refers to the number of individual plants that occur within a given unit area. In an aspect, a corn field comprises a density of at least 9,000 corn plants per acre. In another aspect, a corn field comprises a density of at least 12,000 corn plants per acre. In another aspect, a corn field comprises a density of at least 15,000 corn plants per acre. In another aspect, a corn field comprises a density of at least 18,000 corn plants per acre. In another aspect, a corn field comprises a density of at least 21,000 corn plants per acre. In another aspect, a corn field comprises a density of at least 24,000 corn plants per acre. In another aspect, a corn field comprises a density of at least 27,000 corn plants per acre. In another aspect, a corn field comprises a density of at least 30,000 corn plants per acre. In another aspect, a corn field comprises a density of at least 33,000 corn plants per acre. In another aspect, a corn field comprises a density of at least 36,000 corn plants per acre. In another aspect, a corn field comprises a density of at least 39,000 corn plants per acre. In another aspect, a corn field comprises a density of at least 42,000 corn plants per acre. In another aspect, a corn field comprises a density of at least 45,000 corn plants per acre. In another aspect, a corn field comprises a density of at least 48,000 corn plants per acre. In another aspect, a corn field comprises a density of at least 51,000 corn plants per acre. In another aspect, a corn field comprises a density of at least 54,000 corn plants per acre. In another aspect, a corn field comprises a density of at least 57,000 corn plants per acre. In another aspect, a corn field comprises a density of at least 60,000 corn plants per acre. In another aspect, a corn field comprises a density of at least 63,000 corn plants per acre. In another aspect, a corn field comprises a density of at least 66,000 corn plants per acre. In another aspect, a corn field comprises a density of at least 69,000 corn plants per acre. In another aspect, a corn field comprises a density of at least 72,000 corn plants per acre. In another aspect, a corn field comprises a density of at least 75,000 corn plants per acre.

In an aspect, a corn field comprises a density of between 20,000 corn plants and 60,000 corn plants per acre. In another aspect, a corn field comprises a density of between 20,000 corn plants and 55,000 corn plants per acre. In another aspect, a corn field comprises a density of between 20,000 corn plants and 50,000 corn plants per acre. In another aspect, a corn field comprises a density of between 20,000 corn plants and 45,000 corn plants per acre. In another aspect, a corn field comprises a density of between 20,000 corn plants and 40,000 corn plants per acre. In another aspect, a corn field comprises a density of between 20,000 corn plants and 35,000 corn plants per acre. In another aspect, a corn field comprises a density of between 20,000 corn plants and 30,000 corn plants per acre. In another aspect, a corn field comprises a density of between 24,000 corn plants and 58,000 corn plants per acre. In another aspect, a corn field comprises a density of between 38,000 corn plants and 60,000 corn plants per acre. In another aspect, a corn field comprises a density of between 38,000 corn plants and 50,000 corn plants per acre. In an aspect, a corn field comprises a density of less than 10,000 corn plants per acre. In another aspect, a corn field comprises a density of less than 20,000 corn plants per acre. In another aspect, a corn field comprises a density of less than 30,000 corn plants per acre.

In an aspect, a corn field comprises at least one corn plant and further comprises a density of at least 9,000 corn plants per acre. In another aspect, a corn field comprises at least one corn plant and further comprises a density of at least 12,000 corn plants per acre. In another aspect, a corn field comprises at least one corn plant and further comprises a density of at least 15,000 corn plants per acre. In another aspect, a corn field comprises at least one corn plant and further comprises a density of at least 18,000 corn plants per acre. In another aspect, a corn field comprises at least one corn plant and further comprises a density of at least 21,000 corn plants per acre. In another aspect, a corn field comprises at least one corn plant and further comprises a density of at least 24,000 corn plants per acre. In another aspect, a corn field comprises at least one corn plant and further comprises a density of at least 27,000 corn plants per acre. In another aspect, a corn field comprises at least one corn plant and further comprises a density of at least 30,000 corn plants per acre. In another aspect, a corn field comprises at least one corn plant and further comprises a density of at least 33,000 corn plants per acre. In another aspect, a corn field comprises at least one corn plant and further comprises a density of at least 36,000 corn plants per acre. In another aspect, a corn field comprises at least one corn plant and further comprises a density of at least one corn plant per acre. In another aspect, a corn field comprises at least one corn plant and further comprises a density of at least 42,000 corn plants per acre. In another aspect, a corn field comprises at least one corn plant and further comprises a density of at least 45,000 corn plants per acre. In another aspect, a corn field comprises at least one corn plant and further comprises a density of at least 48,000 corn plants per acre. In another aspect, a corn field comprises at least one corn plant and further comprises a density of at least 51,000 corn plants per acre. In another aspect, a corn field comprises at least one corn plant and further comprises a density of at least 54,000 corn plants per acre. In another aspect, a corn field comprises at least one corn plant and further comprises a density of at least 57,000 corn plants per acre. In another aspect, a corn field comprises at least one corn plant and further comprises a density of at least 60,000 corn plants per acre. In another aspect, a corn field comprises at least one corn plant and further comprises a density of at least 63,000 corn plants per acre. In another aspect, a corn field comprises at least one corn plant and further comprises a density of at least 66,000 corn plants per acre. In another aspect, a corn field comprises at least one corn plant and further comprises a density of at least 69,000 corn plants per acre. In another aspect, a corn field comprises at least one corn plant and further comprises a density of at least 72,000 corn plants per acre. In another aspect, a corn field comprises at least one corn plant and further comprises a density of at least 75,000 corn plants per acre.

In an aspect, a corn field comprises at least 1,000 corn plants and further comprises a density of at least 9,000 corn plants per acre. In another aspect, a corn field comprises at least 1,000 corn plants and further comprises a density of at least 12,000 corn plants per acre. In another aspect, a corn field comprises at least 1,000 corn plants and further comprises a density of at least 15,000 corn plants per acre. In another aspect, a corn field comprises at least 1,000 corn plants and further comprises a density of at least 18,000 corn plants per acre. In another aspect, a corn field comprises at least 1,000 corn plants and further comprises a density of at least 21,000 corn plants per acre. In another aspect, a corn field comprises at least 1,000 corn plants and further comprises a density of at least 24,000 corn plants per acre. In another aspect, a corn field comprises at least 1,000 corn plants and further comprises a density of at least 27,000 corn plants per acre. In another aspect, a corn field comprises at least 1,000 corn plants and further comprises a density of at least 30,000 corn plants per acre. In another aspect, a corn field comprises at least 1,000 corn plants and further comprises a density of at least 33,000 corn plants per acre. In another aspect, a corn field comprises at least 1,000 corn plants and further comprises a density of at least 36,000 corn plants per acre. In another aspect, a corn field comprises at least 1,000 corn plants and further comprises a density of at least 39,000 corn plants per acre. In another aspect, a corn field comprises at least 1,000 corn plants and further comprises a density of at least 42,000 corn plants per acre. In another aspect, a corn field comprises at least 1,000 corn plants and further comprises a density of at least 45,000 corn plants per acre. In another aspect, a corn field comprises at least 1,000 corn plants and further comprises a density of at least 48,000 corn plants per acre. In another aspect, a corn field comprises at least 1,000 corn plants and further comprises a density of at least 51,000 corn plants per acre. In another aspect, a corn field comprises at least 1,000 corn plants and further comprises a density of at least 54,000 corn plants per acre. In another aspect, a corn field comprises at least 1,000 corn plants and further comprises a density of at least 57,000 corn plants per acre. In another aspect, a corn field comprises at least 1,000 corn plants and further comprises a density of at least 60,000 corn plants per acre. In another aspect, a corn field comprises at least 1,000 corn plants and further comprises a density of at least 63,000 corn plants per acre. In another aspect, a corn field comprises at least 1,000 corn plants and further comprises a density of at least 66,000 corn plants per acre. In another aspect, a corn field comprises at least 1,000 corn plants and further comprises a density of at least 69,000 corn plants per acre. In another aspect, a corn field comprises at least 1,000 corn plants and further comprises a density of at least 72,000 corn plants per acre. In another aspect, a corn field comprises at least 1,000 corn plants and further comprises a density of at least 75,000 corn plants per acre.

In an aspect, a corn field comprises at least 10,000 corn plants and further comprises a density of at least 9,000 corn plants per acre. In another aspect, a corn field comprises at least 10,000 corn plants and further comprises a density of at least 12,000 corn plants per acre. In another aspect, a corn field comprises at least 10,000 corn plants and further comprises a density of at least 15,000 corn plants per acre. In another aspect, a corn field comprises at least 10,000 corn plants and further comprises a density of at least 18,000 corn plants per acre. In another aspect, a corn field comprises at least 10,000 corn plants and further comprises a density of at least 21,000 corn plants per acre. In another aspect, a corn field comprises at least 10,000 corn plants and further comprises a density of at least 24,000 corn plants per acre. In another aspect, a corn field comprises at least 10,000 corn plants and further comprises a density of at least 27,000 corn plants per acre. In another aspect, a corn field comprises at least 10,000 corn plants and further comprises a density of at least 30,000 corn plants per acre. In another aspect, a corn field comprises at least 10,000 corn plants and further comprises a density of at least 33,000 corn plants per acre. In another aspect, a corn field comprises at least 10,000 corn plants and further comprises a density of at least 36,000 corn plants per acre. In another aspect, a corn field comprises at least 10,000 corn plants and further comprises a density of at least 39,000 corn plants per acre. In another aspect, a corn field comprises at least 10,000 corn plants and further comprises a density of at least 42,000 corn plants per acre. In another aspect, a corn field comprises at least 10,000 corn plants and further comprises a density of at least 45,000 corn plants per acre. In another aspect, a corn field comprises at least 10,000 corn plants and further comprises a density of at least 48,000 corn plants per acre. In another aspect, a corn field comprises at least 10,000 corn plants and further comprises a density of at least 51,000 corn plants per acre. In another aspect, a corn field comprises at least 10,000 corn plants and further comprises a density of at least 54,000 corn plants per acre. In another aspect, a corn field comprises at least 10,000 corn plants and further comprises a density of at least 57,000 corn plants per acre. In another aspect, a corn field comprises at least 10,000 corn plants and further comprises a density of at least 60,000 corn plants per acre. In another aspect, a corn field comprises at least 10,000 corn plants and further comprises a density of at least 63,000 corn plants per acre. In another aspect, a corn field comprises at least 10,000 corn plants and further comprises a density of at least 66,000 corn plants per acre. In another aspect, a corn field comprises at least 10,000 corn plants and further comprises a density of at least 69,000 corn plants per acre. In another aspect, a corn field comprises at least 10,000 corn plants and further comprises a density of at least 72,000 corn plants per acre. In another aspect, a corn field comprises at least 10,000 corn plants and further comprises a density of at least 75,000 corn plants per acre.

In an aspect, a corn field comprises at least 100,000 corn plants and further comprises a density of at least 9,000 corn plants per acre. In another aspect, a corn field comprises at least 100,000 corn plants and further comprises a density of at least 12,000 corn plants per acre. In another aspect, a corn field comprises at least 100,000 corn plants and further comprises a density of at least 15,000 corn plants per acre. In another aspect, a corn field comprises at least 100,000 corn plants and further comprises a density of at least 18,000 corn plants per acre. In another aspect, a corn field comprises at least 100,000 corn plants and further comprises a density of at least 21,000 corn plants per acre. In another aspect, a corn field comprises at least 100,000 corn plants and further comprises a density of at least 24,000 corn plants per acre. In another aspect, a corn field comprises at least 100,000 corn plants and further comprises a density of at least 27,000 corn plants per acre. In another aspect, a corn field comprises at least 100,000 corn plants and further comprises a density of at least 30,000 corn plants per acre. In another aspect, a corn field comprises at least 100,000 corn plants and further comprises a density of at least 33,000 corn plants per acre. In another aspect, a corn field comprises at least 100,000 corn plants and further comprises a density of at least 36,000 corn plants per acre. In another aspect, a corn field comprises at least 100,000 corn plants and further comprises a density of at least 39,000 corn plants per acre. In another aspect, a corn field comprises at least 100,000 corn plants and further comprises a density of at least 42,000 corn plants per acre. In another aspect, a corn field comprises at least 100,000 corn plants and further comprises a density of at least 45,000 corn plants per acre. In another aspect, a corn field comprises at least 100,000 corn plants and further comprises a density of at least 48,000 corn plants per acre. In another aspect, a corn field comprises at least 100,000 corn plants and further comprises a density of at least 51,000 corn plants per acre. In another aspect, a corn field comprises at least 100,000 corn plants and further comprises a density of at least 54,000 corn plants per acre. In another aspect, a corn field comprises at least 100,000 corn plants and further comprises a density of at least 57,000 corn plants per acre. In another aspect, a corn field comprises at least 100,000 corn plants and further comprises a density of at least 60,000 corn plants per acre. In another aspect, a corn field comprises at least 100,000 corn plants and further comprises a density of at least 63,000 corn plants per acre. In another aspect, a corn field comprises at least 100,000 corn plants and further comprises a density of at least 66,000 corn plants per acre. In another aspect, a corn field comprises at least 100,000 corn plants and further comprises a density of at least 69,000 corn plants per acre. In another aspect, a corn field comprises at least 100,000 corn plants and further comprises a density of at least 72,000 corn plants per acre. In another aspect, a corn field comprises at least 100,000 corn plants and further comprises a density of at least 75,000 corn plants per acre.

In an aspect, a corn field comprises at least 1,000,000 corn plants and further comprises a density of at least 9,000 corn plants per acre. In another aspect, a corn field comprises at least 1,000,000 corn plants and further comprises a density of at least 12,000 corn plants per acre. In another aspect, a corn field comprises at least 1,000,000 corn plants and further comprises a density of at least 15,000 corn plants per acre. In another aspect, a corn field comprises at least 1,000,000 corn plants and further comprises a density of at least 18,000 corn plants per acre. In another aspect, a corn field comprises at least 1,000,000 corn plants and further comprises a density of at least 21,000 corn plants per acre. In another aspect, a corn field comprises at least 1,000,000 corn plants and further comprises a density of at least 24,000 corn plants per acre. In another aspect, a corn field comprises at least 1,000,000 corn plants and further comprises a density of at least 27,000 corn plants per acre. In another aspect, a corn field comprises at least 1,000,000 corn plants and further comprises a density of at least 30,000 corn plants per acre. In another aspect, a corn field comprises at least 1,000,000 corn plants and further comprises a density of at least 33,000 corn plants per acre. In another aspect, a corn field comprises at least 1,000,000 corn plants and further comprises a density of at least 36,000 corn plants per acre. In another aspect, a corn field comprises at least 1,000,000 corn plants and further comprises a density of at least 39,000 corn plants per acre. In another aspect, a corn field comprises at least 1,000,000 corn plants and further comprises a density of at least 42,000 corn plants per acre. In another aspect, a corn field comprises at least 1,000,000 corn plants and further comprises a density of at least 45,000 corn plants per acre. In another aspect, a corn field comprises at least 1,000,000 corn plants and further comprises a density of at least 48,000 corn plants per acre. In another aspect, a corn field comprises at least 1,000,000 corn plants and further comprises a density of at least 51,000 corn plants per acre. In another aspect, a corn field comprises at least 1,000,000 corn plants and further comprises a density of at least 54,000 corn plants per acre. In another aspect, a corn field comprises at least 1,000,000 corn plants and further comprises a density of at least 57,000 corn plants per acre. In another aspect, a corn field comprises at least 1,000,000 corn plants and further comprises a density of at least 60,000 corn plants per acre. In another aspect, a corn field comprises at least 1,000,000 corn plants and further comprises a density of at least 63,000 corn plants per acre. In another aspect, a corn field comprises at least 1,000,000 corn plants and further comprises a density of at least 66,000 corn plants per acre. In another aspect, a corn field comprises at least 1,000,000 corn plants and further comprises a density of at least 69,000 corn plants per acre. In another aspect, a corn field comprises at least 1,000,000 corn plants and further comprises a density of at least 72,000 corn plants per acre. In another aspect, a corn field comprises at least 1,000,000 corn plants and further comprises a density of at least 75,000 corn plants per acre.

In an aspect, a corn field comprises at least 10,000,000 corn plants and further comprises a density of at least 9,000 corn plants per acre. In another aspect, a corn field comprises at least 10,000,000 corn plants and further comprises a density of at least 12,000 corn plants per acre. In another aspect, a corn field comprises at least 10,000,000 corn plants and further comprises a density of at least 15,000 corn plants per acre. In another aspect, a corn field comprises at least 10,000,000 corn plants and further comprises a density of at least 18,000 corn plants per acre. In another aspect, a corn field comprises at least 10,000,000 corn plants and further comprises a density of at least 21,000 corn plants per acre. In another aspect, a corn field comprises at least 10,000,000 corn plants and further comprises a density of at least 24,000 corn plants per acre. In another aspect, a corn field comprises at least 10,000,000 corn plants and further comprises a density of at least 27,000 corn plants per acre. In another aspect, a corn field comprises at least 10,000,000 corn plants and further comprises a density of at least 30,000 corn plants per acre. In another aspect, a corn field comprises at least 10,000,000 corn plants and further comprises a density of at least 33,000 corn plants per acre. In another aspect, a corn field comprises at least 10,000,000 corn plants and further comprises a density of at least 36,000 corn plants per acre. In another aspect, a corn field comprises at least 10,000,000 corn plants and further comprises a density of at least 39,000 corn plants per acre. In another aspect, a corn field comprises at least 10,000,000 corn plants and further comprises a density of at least 42,000 corn plants per acre. In another aspect, a corn field comprises at least 10,000,000 corn plants and further comprises a density of at least 45,000 corn plants per acre. In another aspect, a corn field comprises at least 10,000,000 corn plants and further comprises a density of at least 48,000 corn plants per acre. In another aspect, a corn field comprises at least 10,000,000 corn plants and further comprises a density of at least 51,000 corn plants per acre. In another aspect, a corn field comprises at least 10,000,000 corn plants and further comprises a density of at least 54,000 corn plants per acre. In another aspect, a corn field comprises at least 10,000,000 corn plants and further comprises a density of at least 57,000 corn plants per acre. In another aspect, a corn field comprises at least 10,000,000 corn plants and further comprises a density of at least 60,000 corn plants per acre. In another aspect, a corn field comprises at least 10,000,000 corn plants and further comprises a density of at least 63,000 corn plants per acre. In another aspect, a corn field comprises at least 10,000,000 corn plants and further comprises a density of at least 66,000 corn plants per acre. In another aspect, a corn field comprises at least 10,000,000 corn plants and further comprises a density of at least 69,000 corn plants per acre. In another aspect, a corn field comprises at least 10,000,000 corn plants and further comprises a density of at least 72,000 corn plants per acre. In another aspect, a corn field comprises at least 10,000,000 corn plants and further comprises a density of at least 75,000 corn plants per acre.

In an aspect, a corn field comprises at least one corn plant and further comprises a density of between 20,000 corn plants and 55,000 corn plants per acre. In another aspect, a corn field comprises at least one corn plant and further comprises a density of between 20,000 corn plants and 50,000 corn plants per acre. In another aspect, a corn field comprises at least one corn plant and further comprises a density of between 20,000 corn plants and 45,000 corn plants per acre. In another aspect, a corn field comprises at least one corn plant and further comprises a density of between 20,000 corn plants and 40,000 corn plants per acre. In another aspect, a corn field comprises at least one corn plant and further comprises a density of between 20,000 corn plants and 35,000 corn plants per acre. In another aspect, a corn field comprises at least one corn plant and further comprises a density of between 20,000 corn plants and 30,000 corn plants per acre. In another aspect, a corn field comprises at least one corn plant and further comprises a density of between 24,000 corn plants and 58,000 corn plants per acre. In another aspect, a corn field comprises at least one corn plant and further comprises a density of between 38,000 corn plants and 60,000 corn plants per acre. In another aspect, a corn field comprises at least one corn plant and further comprises a density of between 38,000 corn plants and 50,000 corn plants per acre. In another aspect, a corn field comprises at least one corn plant and further comprises a density of less than 10,000 corn plants per acre. In another aspect, a corn field comprises at least one corn plant and further comprises a density of less than 20,000 corn plants per acre. In another aspect, a corn field comprises at least one corn plant and further comprises a density of less than 30,000 corn plants per acre.

In an aspect, a corn field comprises at least 1,000 corn plants and further comprises a density of between 20,000 corn plants and 55,000 corn plants per acre. In another aspect, a corn field comprises at least 1,000 corn plants and further comprises a density of between 20,000 corn plants and 50,000 corn plants per acre. In another aspect, a corn field comprises at least 1,000 corn plants and further comprises a density of between 20,000 corn plants and 45,000 corn plants per acre. In another aspect, a corn field comprises at least 1,000 corn plants and further comprises a density of between 20,000 corn plants and 40,000 corn plants per acre. In another aspect, a corn field comprises at least 1,000 corn plants and further comprises a density of between 20,000 corn plants and 35,000 corn plants per acre. In another aspect, a corn field comprises at least 1,000 corn plants and further comprises a density of between 20,000 corn plants and 30,000 corn plants per acre. In another aspect, a corn field comprises at least 1,000 corn plants and further comprises a density of between 24,000 corn plants and 58,000 corn plants per acre. In another aspect, a corn field comprises at least 1,000 corn plants and further comprises a density of between 38,000 corn plants and 60,000 corn plants per acre. In another aspect, a corn field comprises at least 1,000 corn plants and further comprises a density of between 38,000 corn plants and 50,000 corn plants per acre. In another aspect, a corn field comprises at least 1,000 corn plants and further comprises a density of less than 10,000 corn plants per acre. In another aspect, a corn field comprises at least 1,000 corn plants and further comprises a density of less than 20,000 corn plants per acre. In another aspect, a corn field comprises at least 1,000 corn plants and further comprises a density of less than 30,000 corn plants per acre.

In an aspect, a corn field comprises at least 10,000 corn plants and further comprises a density of between 20,000 corn plants and 55,000 corn plants per acre. In another aspect, a corn field comprises at least 10,000 corn plants and further comprises a density of between 20,000 corn plants and 50,000 corn plants per acre. In another aspect, a corn field comprises at least 10,000 corn plants and further comprises a density of between 20,000 corn plants and 45,000 corn plants per acre. In another aspect, a corn field comprises at least 10,000 corn plants and further comprises a density of between 20,000 corn plants and 40,000 corn plants per acre. In another aspect, a corn field comprises at least 10,000 corn plants and further comprises a density of between 20,000 corn plants and 35,000 corn plants per acre. In another aspect, a corn field comprises at least 10,000 corn plants and further comprises a density of between 20,000 corn plants and 30,000 corn plants per acre. In another aspect, a corn field comprises at least 10,000 corn plants and further comprises a density of between 24,000 corn plants and 58,000 corn plants per acre. In another aspect, a corn field comprises at least 10,000 corn plants and further comprises a density of between 38,000 corn plants and 60,000 corn plants per acre. In another aspect, a corn field comprises at least 10,000 corn plants and further comprises a density of between 38,000 corn plants and 50,000 corn plants per acre. In another aspect, a corn field comprises at least 10,000 corn plants and further comprises a density of less than 10,000 corn plants per acre. In another aspect, a corn field comprises at least 10,000 corn plants and further comprises a density of less than 20,000 corn plants per acre. In another aspect, a corn field comprises at least 10,000 corn plants and further comprises a density of less than 30,000 corn plants per acre.

In an aspect, a corn field comprises at least 100,000 corn plants and further comprises a density of between 20,000 corn plants and 55,000 corn plants per acre. In another aspect, a corn field comprises at least 100,000 corn plants and further comprises a density of between 20,000 corn plants and 50,000 corn plants per acre. In another aspect, a corn field comprises at least 100,000 corn plants and further comprises a density of between 20,000 corn plants and 45,000 corn plants per acre. In another aspect, a corn field comprises at least 100,000 corn plants and further comprises a density of between 20,000 corn plants and 40,000 corn plants per acre. In another aspect, a corn field comprises at least 100,000 corn plants and further comprises a density of between 20,000 corn plants and 35,000 corn plants per acre. In another aspect, a corn field comprises at least 100,000 corn plants and further comprises a density of between 20,000 corn plants and 30,000 corn plants per acre. In another aspect, a corn field comprises at least 100,000 corn plants and further comprises a density of between 24,000 corn plants and 58,000 corn plants per acre. In another aspect, a corn field comprises at least 100,000 corn plants and further comprises a density of between 38,000 corn plants and 60,000 corn plants per acre. In another aspect, a corn field comprises at least 100,000 corn plants and further comprises a density of between 38,000 corn plants and 50,000 corn plants per acre. In another aspect, a corn field comprises at least 100,000 corn plants and further comprises a density of less than 10,000 corn plants per acre. In another aspect, a corn field comprises at least 100,000 corn plants and further comprises a density of less than 20,000 corn plants per acre. In another aspect, a corn field comprises at least 100,000 corn plants and further comprises a density of less than 30,000 corn plants per acre.

In an aspect, a corn field comprises at least 1,000,000 corn plants and further comprises a density of between 20,000 corn plants and 55,000 corn plants per acre. In another aspect, a corn field comprises at least 1,000,000 corn plants and further comprises a density of between 20,000 corn plants and 50,000 corn plants per acre. In another aspect, a corn field comprises at least 1,000,000 corn plants and further comprises a density of between 20,000 corn plants and 45,000 corn plants per acre. In another aspect, a corn field comprises at least 1,000,000 corn plants and further comprises a density of between 20,000 corn plants and 40,000 corn plants per acre. In another aspect, a corn field comprises at least 1,000,000 corn plants and further comprises a density of between 20,000 corn plants and 35,000 corn plants per acre. In another aspect, a corn field comprises at least 1,000,000 corn plants and further comprises a density of between 20,000 corn plants and 30,000 corn plants per acre. In another aspect, a corn field comprises at least 1,000,000 corn plants and further comprises a density of between 24,000 corn plants and 58,000 corn plants per acre. In another aspect, a corn field comprises at least 1,000,000 corn plants and further comprises a density of between 38,000 corn plants and 60,000 corn plants per acre. In another aspect, a corn field comprises at least 1,000,000 corn plants and further comprises a density of between 38,000 corn plants and 50,000 corn plants per acre. In another aspect, a corn field comprises at least 1,000,000 corn plants and further comprises a density of less than 10,000 corn plants per acre. In another aspect, a corn field comprises at least 1,000,000 corn plants and further comprises a density of less than 20,000 corn plants per acre. In another aspect, a corn field comprises at least 1,000,000 corn plants and further comprises a density of less than 30,000 corn plants per acre.

In an aspect, a corn field comprises at least 10,000,000 corn plants and further comprises a density of between 20,000 corn plants and 55,000 corn plants per acre. In another aspect, a corn field comprises at least 10,000,000 corn plants and further comprises a density of between 20,000 corn plants and 50,000 corn plants per acre. In another aspect, a corn field comprises at least 10,000,000 corn plants and further comprises a density of between 20,000 corn plants and 45,000 corn plants per acre. In another aspect, a corn field comprises at least 10,000,000 corn plants and further comprises a density of between 20,000 corn plants and 40,000 corn plants per acre. In another aspect, a corn field comprises at least 10,000,000 corn plants and further comprises a density of between 20,000 corn plants and 35,000 corn plants per acre. In another aspect, a corn field comprises at least 10,000,000 corn plants and further comprises a density of between 20,000 corn plants and 30,000 corn plants per acre. In another aspect, a corn field comprises at least 10,000,000 corn plants and further comprises a density of between 24,000 corn plants and 58,000 corn plants per acre. In another aspect, a corn field comprises at least 10,000,000 corn plants and further comprises a density of between 38,000 corn plants and 60,000 corn plants per acre. In another aspect, a corn field comprises at least 10,000,000 corn plants and further comprises a density of between 38,000 corn plants and 50,000 corn plants per acre. In another aspect, a corn field comprises at least 10,000,000 corn plants and further comprises a density of less than 10,000 corn plants per acre. In another aspect, a corn field comprises at least 10,000,000 corn plants and further comprises a density of less than 20,000 corn plants per acre. In another aspect, a corn field comprises at least 10,000,000 corn plants and further comprises a density of less than 30,000 corn plants per acre.

In an aspect, a corn field comprises between one and 1,000 corn plants and further comprises a density of at least 9,000 corn plants per acre. In another aspect, a corn field comprises between one and 1,000 corn plants and further comprises a density of at least 12,000 corn plants per acre. In another aspect, a corn field comprises between one and 1,000 corn plants and further comprises a density of at least 15,000 corn plants per acre. In another aspect, a corn field comprises between one and 1,000 corn plants and further comprises a density of at least 18,000 corn plants per acre. In another aspect, a corn field comprises between one and 1,000 corn plants and further comprises a density of at least 21,000 corn plants per acre. In another aspect, a corn field comprises between one and 1,000 corn plants and further comprises a density of at least 24,000 corn plants per acre. In another aspect, a corn field comprises between one and 1,000 corn plants and further comprises a density of at least 27,000 corn plants per acre. In another aspect, a corn field comprises between one and 1,000 corn plants and further comprises a density of at least 30,000 corn plants per acre. In another aspect, a corn field comprises between one and 1,000 corn plants and further comprises a density of at least 33,000 corn plants per acre. In another aspect, a corn field comprises between one and 1,000 corn plants and further comprises a density of at least 36,000 corn plants per acre. In another aspect, a corn field comprises between one and 1,000 corn plants and further comprises a density of at least 39,000 corn plants per acre. In another aspect, a corn field comprises between one and 1,000 corn plants and further comprises a density of at least 42,000 corn plants per acre. In another aspect, a corn field comprises between one and 1,000 corn plants and further comprises a density of at least 45,000 corn plants per acre. In another aspect, a corn field comprises between one and 1,000 corn plants and further comprises a density of at least 48,000 corn plants per acre. In another aspect, a corn field comprises between one and 1,000 corn plants and further comprises a density of at least 51,000 corn plants per acre. In another aspect, a corn field comprises between one and 1,000 corn plants and further comprises a density of at least 54,000 corn plants per acre. In another aspect, a corn field comprises between one and 1,000 corn plants and further comprises a density of at least 57,000 corn plants per acre. In another aspect, a corn field comprises between one and 1,000 corn plants and further comprises a density of at least 60,000 corn plants per acre. In another aspect, a corn field comprises between one and 1,000 corn plants and further comprises a density of at least 63,000 corn plants per acre. In another aspect, a corn field comprises between one and 1,000 corn plants and further comprises a density of at least 66,000 corn plants per acre. In another aspect, a corn field comprises between one and 1,000 corn plants and further comprises a density of at least 69,000 corn plants per acre. In another aspect, a corn field comprises between one and 1,000 corn plants and further comprises a density of at least 72,000 corn plants per acre. In another aspect, a corn field comprises between one and 1,000 corn plants and further comprises a density of at least 75,000 corn plants per acre.

In an aspect, a corn field comprises between 1,000 and 10,000 corn plants and further comprises a density of at least 9,000 corn plants per acre. In another aspect, a corn field comprises between 1,000 and 10,000 corn plants and further comprises a density of at least 12,000 corn plants per acre. In another aspect, a corn field comprises between 1,000 and 10,000 corn plants and further comprises a density of at least 15,000 corn plants per acre. In another aspect, a corn field comprises between 1,000 and 10,000 corn plants and further comprises a density of at least 18,000 corn plants per acre. In another aspect, a corn field comprises between 1,000 and 10,000 corn plants and further comprises a density of at least 21,000 corn plants per acre. In another aspect, a corn field comprises between 1,000 and 10,000 corn plants and further comprises a density of at least 24,000 corn plants per acre. In another aspect, a corn field comprises between 1,000 and 10,000 corn plants and further comprises a density of at least 27,000 corn plants per acre. In another aspect, a corn field comprises between 1,000 and 10,000 corn plants and further comprises a density of at least 30,000 corn plants per acre. In another aspect, a corn field comprises between 1,000 and 10,000 corn plants and further comprises a density of at least 33,000 corn plants per acre. In another aspect, a corn field comprises between 1,000 and 10,000 corn plants and further comprises a density of at least 36,000 corn plants per acre. In another aspect, a corn field comprises between 1,000 and 10,000 corn plants and further comprises a density of at least 39,000 corn plants per acre. In another aspect, a corn field comprises between 1,000 and 10,000 corn plants and further comprises a density of at least 42,000 corn plants per acre. In another aspect, a corn field comprises between 1,000 and 10,000 corn plants and further comprises a density of at least 45,000 corn plants per acre. In another aspect, a corn field comprises between 1,000 and 10,000 corn plants and further comprises a density of at least 48,000 corn plants per acre. In another aspect, a corn field comprises between 1,000 and 10,000 corn plants and further comprises a density of at least 51,000 corn plants per acre. In another aspect, a corn field comprises between 1,000 and 10,000 corn plants and further comprises a density of at least 54,000 corn plants per acre. In another aspect, a corn field comprises between 1,000 and 10,000 corn plants and further comprises a density of at least 57,000 corn plants per acre. In another aspect, a corn field comprises between 1,000 and 10,000 corn plants and further comprises a density of at least 60,000 corn plants per acre. In another aspect, a corn field comprises between 1,000 and 10,000 corn plants and further comprises a density of at least 63,000 corn plants per acre. In another aspect, a corn field comprises between 1,000 and 10,000 corn plants and further comprises a density of at least 66,000 corn plants per acre. In another aspect, a corn field comprises between 1,000 and 10,000 corn plants and further comprises a density of at least 69,000 corn plants per acre. In another aspect, a corn field comprises between 1,000 and 10,000 corn plants and further comprises a density of at least 72,000 corn plants per acre. In another aspect, a corn field comprises between 1,000 and 10,000 corn plants and further comprises a density of at least 75,000 corn plants per acre.

In an aspect, a corn field comprises between 10,000 and 100,000 corn plants and further comprises a density of at least 9,000 corn plants per acre. In another aspect, a corn field comprises between 10,000 and 100,000 corn plants and further comprises a density of at least 12,000 corn plants per acre. In another aspect, a corn field comprises between 10,000 and 100,000 corn plants and further comprises a density of at least 15,000 corn plants per acre. In another aspect, a corn field comprises between 10,000 and 100,000 corn plants and further comprises a density of at least 18,000 corn plants per acre. In another aspect, a corn field comprises between 10,000 and 100,000 corn plants and further comprises a density of at least 21,000 corn plants per acre. In another aspect, a corn field comprises between 10,000 and 100,000 corn plants and further comprises a density of at least 24,000 corn plants per acre. In another aspect, a corn field comprises between 10,000 and 100,000 corn plants and further comprises a density of at least 27,000 corn plants per acre. In another aspect, a corn field comprises between 10,000 and 100,000 corn plants and further comprises a density of at least 30,000 corn plants per acre. In another aspect, a corn field comprises between 10,000 and 100,000 corn plants and further comprises a density of at least 33,000 corn plants per acre. In another aspect, a corn field comprises between 10,000 and 100,000 corn plants and further comprises a density of at least 36,000 corn plants per acre. In another aspect, a corn field comprises between 10,000 and 100,000 corn plants and further comprises a density of at least 39,000 corn plants per acre. In another aspect, a corn field comprises between 10,000 and 100,000 corn plants and further comprises a density of at least 42,000 corn plants per acre. In another aspect, a corn field comprises between 10,000 and 100,000 corn plants and further comprises a density of at least 45,000 corn plants per acre. In another aspect, a corn field comprises between 10,000 and 100,000 corn plants and further comprises a density of at least 48,000 corn plants per acre. In another aspect, a corn field comprises between 10,000 and 100,000 corn plants and further comprises a density of at least 51,000 corn plants per acre. In another aspect, a corn field comprises between 10,000 and 100,000 corn plants and further comprises a density of at least 54,000 corn plants per acre. In another aspect, a corn field comprises between 10,000 and 100,000 corn plants and further comprises a density of at least 57,000 corn plants per acre. In another aspect, a corn field comprises between 10,000 and 100,000 corn plants and further comprises a density of at least 60,000 corn plants per acre. In another aspect, a corn field comprises between 10,000 and 100,000 corn plants and further comprises a density of at least 63,000 corn plants per acre. In another aspect, a corn field comprises between 10,000 and 100,000 corn plants and further comprises a density of at least 66,000 corn plants per acre. In another aspect, a corn field comprises between 10,000 and 100,000 corn plants and further comprises a density of at least 69,000 corn plants per acre. In another aspect, a corn field comprises between 10,000 and 100,000 corn plants and further comprises a density of at least 72,000 corn plants per acre. In another aspect, a corn field comprises between 10,000 and 100,000 corn plants and further comprises a density of at least 75,000 corn plants per acre.

In an aspect, a corn field comprises between 100,000 and 1,000,000 corn plants and further comprises a density of at least 9,000 corn plants per acre. In another aspect, a corn field comprises between 100,000 and 1,000,000 corn plants and further comprises a density of at least 12,000 corn plants per acre. In another aspect, a corn field comprises between 100,000 and 1,000,000 corn plants and further comprises a density of at least 15,000 corn plants per acre. In another aspect, a corn field comprises between 100,000 and 1,000,000 corn plants and further comprises a density of at least 18,000 corn plants per acre. In another aspect, a corn field comprises between 100,000 and 1,000,000 corn plants and further comprises a density of at least 21,000 corn plants per acre. In another aspect, a corn field comprises between 100,000 and 1,000,000 corn plants and further comprises a density of at least 24,000 corn plants per acre. In another aspect, a corn field comprises between 100,000 and 1,000,000 corn plants and further comprises a density of at least 27,000 corn plants per acre. In another aspect, a corn field comprises between 100,000 and 1,000,000 corn plants and further comprises a density of at least 30,000 corn plants per acre. In another aspect, a corn field comprises between 100,000 and 1,000,000 corn plants and further comprises a density of at least 33,000 corn plants per acre. In another aspect, a corn field comprises between 100,000 and 1,000,000 corn plants and further comprises a density of at least 36,000 corn plants per acre. In another aspect, a corn field comprises between 100,000 and 1,000,000 corn plants and further comprises a density of at least 39,000 corn plants per acre. In another aspect, a corn field comprises between 100,000 and 1,000,000 corn plants and further comprises a density of at least 42,000 corn plants per acre. In another aspect, a corn field comprises between 100,000 and 1,000,000 corn plants and further comprises a density of at least 45,000 corn plants per acre. In another aspect, a corn field comprises between 100,000 and 1,000,000 corn plants and further comprises a density of at least 48,000 corn plants per acre. In another aspect, a corn field comprises between 100,000 and 1,000,000 corn plants and further comprises a density of at least 51,000 corn plants per acre. In another aspect, a corn field comprises between 100,000 and 1,000,000 corn plants and further comprises a density of at least 54,000 corn plants per acre. In another aspect, a corn field comprises between 100,000 and 1,000,000 corn plants and further comprises a density of at least 57,000 corn plants per acre. In another aspect, a corn field comprises between 100,000 and 1,000,000 corn plants and further comprises a density of at least 60,000 corn plants per acre. In another aspect, a corn field comprises between 100,000 and 1,000,000 corn plants and further comprises a density of at least 63,000 corn plants per acre. In another aspect, a corn field comprises between 100,000 and 1,000,000 corn plants and further comprises a density of at least 66,000 corn plants per acre. In another aspect, a corn field comprises between 100,000 and 1,000,000 corn plants and further comprises a density of at least 69,000 corn plants per acre. In another aspect, a corn field comprises between 100,000 and 1,000,000 corn plants and further comprises a density of at least 72,000 corn plants per acre. In another aspect, a corn field comprises between 100,000 and 1,000,000 corn plants and further comprises a density of at least 75,000 corn plants per acre.

In an aspect, a corn field comprises between 1,000,000 and 10,000,000 corn plants and further comprises a density of at least 9,000 corn plants per acre. In another aspect, a corn field comprises between 1,000,000 and 10,000,000 corn plants and further comprises a density of at least 12,000 corn plants per acre. In another aspect, a corn field comprises between 1,000,000 and 10,000,000 corn plants and further comprises a density of at least 15,000 corn plants per acre. In another aspect, a corn field comprises between 1,000,000 and 10,000,000 corn plants and further comprises a density of at least 18,000 corn plants per acre. In another aspect, a corn field comprises between 1,000,000 and 10,000,000 corn plants and further comprises a density of at least 21,000 corn plants per acre. In another aspect, a corn field comprises between 1,000,000 and 10,000,000 corn plants and further comprises a density of at least 24,000 corn plants per acre. In another aspect, a corn field comprises between 1,000,000 and 10,000,000 corn plants and further comprises a density of at least 27,000 corn plants per acre. In another aspect, a corn field comprises between 1,000,000 and 10,000,000 corn plants and further comprises a density of at least 30,000 corn plants per acre. In another aspect, a corn field comprises between 1,000,000 and 10,000,000 corn plants and further comprises a density of at least 33,000 corn plants per acre. In another aspect, a corn field comprises between 1,000,000 and 10,000,000 corn plants and further comprises a density of at least 36,000 corn plants per acre. In another aspect, a corn field comprises between 1,000,000 and 10,000,000 corn plants and further comprises a density of at least 39,000 corn plants per acre. In another aspect, a corn field comprises between 1,000,000 and 10,000,000 corn plants and further comprises a density of at least 42,000 corn plants per acre. In another aspect, a corn field comprises between 1,000,000 and 10,000,000 corn plants and further comprises a density of at least 45,000 corn plants per acre. In another aspect, a corn field comprises between 1,000,000 and 10,000,000 corn plants and further comprises a density of at least 48,000 corn plants per acre. In another aspect, a corn field comprises between 1,000,000 and 10,000,000 corn plants and further comprises a density of at least 51,000 corn plants per acre. In another aspect, a corn field comprises between 1,000,000 and 10,000,000 corn plants and further comprises a density of at least 54,000 corn plants per acre. In another aspect, a corn field comprises between 1,000,000 and 10,000,000 corn plants and further comprises a density of at least 57,000 corn plants per acre. In another aspect, a corn field comprises between 1,000,000 and 10,000,000 corn plants and further comprises a density of at least 60,000 corn plants per acre. In another aspect, a corn field comprises between 1,000,000 and 10,000,000 corn plants and further comprises a density of at least 63,000 corn plants per acre. In another aspect, a corn field comprises between 1,000,000 and 10,000,000 corn plants and further comprises a density of at least 66,000 corn plants per acre. In another aspect, a corn field comprises between 1,000,000 and 10,000,000 corn plants and further comprises a density of at least 69,000 corn plants per acre. In another aspect, a corn field comprises between 1,000,000 and 10,000,000 corn plants and further comprises a density of at least 72,000 corn plants per acre. In another aspect, a corn field comprises between 1,000,000 and 10,000,000 corn plants and further comprises a density of at least 75,000 corn plants per acre.

In an aspect, a corn field comprises between one and 1,000 corn plants and further comprises a density of between 20,000 corn plants and 55,000 corn plants per acre. In another aspect, a corn field comprises between one and 1,000 corn plants and further comprises a density of between 20,000 corn plants and 50,000 corn plants per acre. In another aspect, a corn field comprises between one and 1,000 corn plants and further comprises a density of between 20,000 corn plants and 45,000 corn plants per acre. In another aspect, a corn field comprises between one and 1,000 corn plants and further comprises a density of between 20,000 corn plants and 40,000 corn plants per acre. In another aspect, a corn field comprises between one and 1,000 corn plants and further comprises a density of between 20,000 corn plants and 35,000 corn plants per acre. In another aspect, a corn field comprises between one and 1,000 corn plants and further comprises a density of between 20,000 corn plants and 30,000 corn plants per acre. In another aspect, a corn field comprises between one and 1,000 corn plants and further comprises a density of between 24,000 corn plants and 58,000 corn plants per acre. In another aspect, a corn field comprises between one and 1,000 corn plants and further comprises a density of between 38,000 corn plants and 60,000 corn plants per acre. In another aspect, a corn field comprises between one and 1,000 corn plants and further comprises a density of between 38,000 corn plants and 50,000 corn plants per acre. In another aspect, a corn field comprises between one and 1,000 corn plants and further comprises a density of less than 10,000 corn plants per acre. In another aspect, a corn field comprises between one and 1,000 corn plants and further comprises a density of less than 20,000 corn plants per acre. In another aspect, a corn field comprises between one and 1,000 corn plants and further comprises a density of less than 30,000 corn plants per acre.

In an aspect, a corn field comprises between 1,000 and 10,000 corn plants and further comprises a density of between 20,000 corn plants and 55,000 corn plants per acre. In another aspect, a corn field comprises between 1,000 and 10,000 corn plants and further comprises a density of between 20,000 corn plants and 50,000 corn plants per acre. In another aspect, a corn field comprises between 1,000 and 10,000 corn plants and further comprises a density of between 20,000 corn plants and 45,000 corn plants per acre. In another aspect, a corn field comprises between 1,000 and 10,000 corn plants and further comprises a density of between 20,000 corn plants and 40,000 corn plants per acre. In another aspect, a corn field comprises between 1,000 and 10,000 corn plants and further comprises a density of between 20,000 corn plants and 35,000 corn plants per acre. In another aspect, a corn field comprises between 1,000 and 10,000 corn plants and further comprises a density of between 20,000 corn plants and 30,000 corn plants per acre. In another aspect, a corn field comprises between 1,000 and 10,000 corn plants and further comprises a density of between 24,000 corn plants and 58,000 corn plants per acre. In another aspect, a corn field comprises between 1,000 and 10,000 corn plants and further comprises a density of between 38,000 corn plants and 60,000 corn plants per acre. In another aspect, a corn field comprises between 1,000 and 10,000 corn plants and further comprises a density of between 38,000 corn plants and 50,000 corn plants per acre. In another aspect, a corn field comprises between 1,000 and 10,000 corn plants and further comprises a density of less than 10,000 corn plants per acre. In another aspect, a corn field comprises between 1,000 and 10,000 corn plants and further comprises a density of less than 20,000 corn plants per acre. In another aspect, a corn field comprises between 1,000 and 10,000 corn plants and further comprises a density of less than 30,000 corn plants per acre.

In an aspect, a corn field comprises between 10,000 and 100,000 corn plants and further comprises a density of between 20,000 corn plants and 55,000 corn plants per acre. In another aspect, a corn field comprises between 10,000 and 100,000 corn plants and further comprises a density of between 20,000 corn plants and 50,000 corn plants per acre. In another aspect, a corn field comprises between 10,000 and 100,000 corn plants and further comprises a density of between 20,000 corn plants and 45,000 corn plants per acre. In another aspect, a corn field comprises between 10,000 and 100,000 corn plants and further comprises a density of between 20,000 corn plants and 40,000 corn plants per acre. In another aspect, a corn field comprises between 10,000 and 100,000 corn plants and further comprises a density of between 20,000 corn plants and 35,000 corn plants per acre. In another aspect, a corn field comprises between 10,000 and 100,000 corn plants and further comprises a density of between 20,000 corn plants and 30,000 corn plants per acre. In another aspect, a corn field comprises between 10,000 and 100,000 corn plants and further comprises a density of between 24,000 corn plants and 58,000 corn plants per acre. In another aspect, a corn field comprises between 10,000 and 100,000 corn plants and further comprises a density of between 38,000 corn plants and 60,000 corn plants per acre. In another aspect, a corn field comprises between 10,000 and 100,000 corn plants and further comprises a density of between 38,000 corn plants and 50,000 corn plants per acre. In another aspect, a corn field comprises between 10,000 and 100,000 corn plants and further comprises a density of less than 10,000 corn plants per acre. In another aspect, a corn field comprises between 10,000 and 100,000 corn plants and further comprises a density of less than 20,000 corn plants per acre. In another aspect, a corn field comprises between 10,000 and 100,000 corn plants and further comprises a density of less than 30,000 corn plants per acre.

In an aspect, a corn field comprises between 100,000 and 1,000,000 corn plants and further comprises a density of between 20,000 corn plants and 55,000 corn plants per acre. In another aspect, a corn field comprises between 100,000 and 1,000,000 corn plants and further comprises a density of between 20,000 corn plants and 50,000 corn plants per acre. In another aspect, a corn field comprises between 100,000 and 1,000,000 corn plants and further comprises a density of between 20,000 corn plants and 45,000 corn plants per acre. In another aspect, a corn field comprises between 100,000 and 1,000,000 corn plants and further comprises a density of between 20,000 corn plants and 40,000 corn plants per acre. In another aspect, a corn field comprises between 100,000 and 1,000,000 corn plants and further comprises a density of between 20,000 corn plants and 35,000 corn plants per acre. In another aspect, a corn field comprises between 100,000 and 1,000,000 corn plants and further comprises a density of between 20,000 corn plants and 30,000 corn plants per acre. In another aspect, a corn field comprises between 100,000 and 1,000,000 corn plants and further comprises a density of between 24,000 corn plants and 58,000 corn plants per acre. In another aspect, a corn field comprises between 100,000 and 1,000,000 corn plants and further comprises a density of between 38,000 corn plants and 60,000 corn plants per acre. In another aspect, a corn field comprises between 100,000 and 1,000,000 corn plants and further comprises a density of between 38,000 corn plants and 50,000 corn plants per acre. In another aspect, a corn field comprises between 100,000 and 1,000,000 corn plants and further comprises a density of less than 10,000 corn plants per acre. In another aspect, a corn field comprises between 100,000 and 1,000,000 corn plants and further comprises a density of less than 20,000 corn plants per acre. In another aspect, a corn field comprises between 100,000 and 1,000,000 corn plants and further comprises a density of less than 30,000 corn plants per acre.

In an aspect, a corn field comprises between 1,000,000 and 10,000,000 corn plants and further comprises a density of between 20,000 corn plants and 55,000 corn plants per acre. In another aspect, a corn field comprises between 1,000,000 and 10,000,000 corn plants and further comprises a density of between 20,000 corn plants and 50,000 corn plants per acre. In another aspect, a corn field comprises between 1,000,000 and 10,000,000 corn plants and further comprises a density of between 20,000 corn plants and 45,000 corn plants per acre. In another aspect, a corn field comprises between 1,000,000 and 10,000,000 corn plants and further comprises a density of between 20,000 corn plants and 40,000 corn plants per acre. In another aspect, a corn field comprises between 1,000,000 and 10,000,000 corn plants and further comprises a density of between 20,000 corn plants and 35,000 corn plants per acre. In another aspect, a corn field comprises between 1,000,000 and 10,000,000 corn plants and further comprises a density of between 20,000 corn plants and 30,000 corn plants per acre. In another aspect, a corn field comprises between 1,000,000 and 10,000,000 corn plants and further comprises a density of between 24,000 corn plants and 58,000 corn plants per acre. In another aspect, a corn field comprises between 1,000,000 and 10,000,000 corn plants and further comprises a density of between 38,000 corn plants and 60,000 corn plants per acre. In another aspect, a corn field comprises between 1,000,000 and 10,000,000 corn plants and further comprises a density of between 38,000 corn plants and 50,000 corn plants per acre. In another aspect, a corn field comprises between 1,000,000 and 10,000,000 corn plants and further comprises a density of less than 10,000 corn plants per acre. In another aspect, a corn field comprises between 1,000,000 and 10,000,000 corn plants and further comprises a density of less than 20,000 corn plants per acre. In another aspect, a corn field comprises between 1,000,000 and 10,000,000 corn plants and further comprises a density of less than 30,000 corn plants per acre.

As used herein, the term "planting pattern" refers to the spatial arrangement of corn plants within a field. In an aspect, the planting pattern within a field is described as the ratio of female plants to male plants. In an aspect, the planting pattern of plants in a field within a field is random. In another aspect, the planting pattern of plants in a field are arranged in rows of male plants and rows of female plants, and the planting pattern is described as the ratio of male plant rows to female plant rows, or vice versa, within the field. In another aspect, the planting pattern within a field is described by the spacing between rows of plants. In another aspect, the planting pattern within a field is described by the spacing between plants within a given row. In an aspect, the planting pattern of plants in a field are arranged in a regular and repeating pattern of rows, which may comprise one or more rows of male plants or two or more contiguous rows of male plants separated by two or more contiguous rows of female plants, three or more contiguous rows of female plants, four or more contiguous rows of female plants, five or more contiguous rows of female plants, six or more contiguous rows of female plants, seven or more contiguous rows of female plants, eight or more contiguous rows of female plants, nine or more contiguous rows of female plants, or ten or more contiguous rows of female plants, wherein the rows of female and/or male plants are separated by equal (or approximately equal) spacing. In another aspect, the planting pattern of plants in a field are arranged in an irregular and non-repeating pattern of rows. In another aspect, the planting pattern within a field is described by a combination of two or more of the arrangements described above.

In an aspect, a corn field provided herein comprises a ratio of at least 1 female inbred corn plant for every male inbred corn plant. In another aspect, a corn field provided herein comprises a ratio of at least 2 female inbred corn plants for every male inbred corn plant. In another aspect, a corn field provided herein comprises a ratio of at least 3 female inbred corn plants for every male inbred corn plant. In another aspect, a corn field provided herein comprises a ratio of at least 4 female corn inbred plants for every male inbred corn plant. In another aspect, a corn field provided herein comprises a ratio of at least 5 female inbred corn plants for every male inbred corn plant. In another aspect, a corn field provided herein comprises a ratio of at least 6 female inbred corn plants for every male inbred corn plant. In another aspect, a corn field provided herein comprises a ratio of at least 7 female inbred corn plants for every male inbred corn plant. In another aspect, a corn field provided herein comprises a ratio of at least 8 female inbred corn plants for every male inbred corn plant. In another aspect, a corn field provided herein comprises a ratio of at least 9 female inbred corn plants for every male inbred corn plant. In another aspect, a corn field provided herein comprises a ratio of at least 10 female inbred corn plants for every male inbred corn plant. In another aspect, a corn field provided herein comprises a ratio of at least 15 female inbred corn plants for every male inbred corn plant. In another aspect, a corn field provided herein comprises a ratio of at least 20 female inbred corn plants for every male inbred corn plant. In another aspect, a corn field provided herein comprises a ratio of at least 25 female inbred corn plants for every male inbred corn plant. In another aspect, a corn field provided herein comprises a ratio of at least 30 female inbred corn plants for every male inbred corn plant. In another aspect, a corn field provided herein comprises a ratio of at least 35 female inbred corn plants for every male inbred corn plant. In another aspect, a corn field provided herein comprises a ratio of at least 40 female inbred corn plants for every male inbred corn plant. In another aspect, a corn field provided herein comprises a ratio of at least 45 female inbred corn plants for every male inbred corn plant. In another aspect, a corn field provided herein comprises a ratio of at least 50 female inbred corn plants for every male inbred corn plant. In another aspect, a corn field provided herein comprises a ratio of at least 55 female inbred corn plants for every male inbred corn plant. In another aspect, a corn field provided herein comprises a ratio of at least 60 female inbred corn plants for every male inbred corn plant. In another aspect, a corn field provided herein comprises a ratio of at least 65 female inbred corn plants for every male inbred corn plant. In another aspect, a corn field provided herein comprises a ratio of at least 70 female inbred corn plants for every male inbred corn plant. In another aspect, a corn field provided herein comprises a ratio of at least 75 female inbred corn plants for every male inbred corn plant. In another aspect, a corn field provided herein comprises a ratio of at least 80 female inbred corn plants for every male inbred corn plant. In another aspect, a corn field provided herein comprises a ratio of at least 85 female inbred corn plants for every male inbred corn plant. In another aspect, a corn field provided herein comprises a ratio of at least 90 female inbred corn plants for every male inbred corn plant. In another aspect, a corn field provided herein comprises a ratio of at least 95 female inbred corn plants for every male inbred corn plant. In another aspect, a corn field provided herein comprises a ratio of at least 100 female inbred corn plants for every male inbred corn plant. In another aspect, a corn field provided herein comprises a ratio of at least 105 female inbred corn plants for every male inbred corn plant. In another aspect, a corn field provided herein comprises a ratio of at least 110 female inbred corn plants for every male inbred corn plant. In another aspect, a corn field provided herein comprises a ratio of at least 115 female inbred corn plants for every male inbred corn plant. In another aspect, a corn field provided herein comprises a ratio of at least 120 female inbred corn plants for every male inbred corn plant.

In an aspect, a corn field provided herein comprises between 1 and 10 female inbred corn plants for every male inbred corn plant. In another aspect, a corn field provided herein comprises between 5 and 10 female inbred corn plants for every male inbred corn plant. In another aspect, a corn field provided herein comprises between 1 and 20 female inbred corn plants for every male inbred corn plant. In another aspect, a corn field provided herein comprises between 5 and 20 female inbred corn plants for every male inbred corn plant. In another aspect, a corn field provided herein comprises between 5 and 15 female inbred corn plants for every male inbred corn plant. In another aspect, a corn field provided herein comprises between 5 and 10 female inbred corn plants for every two male inbred corn plants. In another aspect, a corn field provided herein comprises between 5 and 20 female inbred corn plants for every two male inbred corn plants. In another aspect, a corn field provided herein comprises between 5 and 15 female inbred corn plants for every two male inbred corn plants. In another aspect, a corn field provided herein comprises between 1 and 30 female inbred corn plants for every male inbred corn plant. In another aspect, a corn field provided herein comprises between 1 and 40 female inbred corn plants for every male inbred corn plant. In another aspect, a corn field provided herein comprises between 1 and 50 female inbred corn plants for every male inbred corn plant. In another aspect, a corn field provided herein comprises between 1 and 60 female inbred corn plants for every male inbred corn plant. In another aspect, a corn field provided herein comprises between 1 and 80 female inbred corn plants for every male inbred corn plant. In another aspect, a corn field provided herein comprises between 1 and 100 female inbred corn plants for every male inbred corn plant. In another aspect, a corn field provided herein comprises between 1 and 120 female inbred corn plants for every male inbred corn plant. In another aspect, a corn field provided herein comprises between 10 and 20 female inbred corn plants for every male inbred corn plant. In another aspect, a corn field provided herein comprises between 20 and 30 female inbred corn plants for every male inbred corn plant. In another aspect, a corn field provided herein comprises between 30 and 40 female inbred corn plants for every male inbred corn plant. In another aspect, a corn field provided herein comprises between 40 and 50 female inbred corn plants for every male inbred corn plant. In another aspect, a corn field provided herein comprises between 50 and 60 female inbred corn plants for every male inbred corn plant. In another aspect, a corn field provided herein comprises between 60 and 70 female inbred corn plants for every male inbred corn plant. In another aspect, a corn field provided herein comprises between 70 and 80 female inbred corn plants for every male inbred corn plant. In another aspect, a corn field provided herein comprises between 80 and 90 female inbred corn plants for every male inbred corn plant. In another aspect, a corn field provided herein comprises between 90 and 100 female inbred corn plants for every male inbred corn plant. In another aspect, a corn field provided herein comprises between 100 and 110 female inbred corn plants for every male inbred corn plant. In another aspect, a corn field provided herein comprises between 110 and 120 female inbred corn plants for every male inbred corn plant. In another aspect, a corn field provided herein comprises between 20 and 40 female inbred corn plants for every male inbred corn plant. In another aspect, a corn field provided herein comprises between 40 and 60 female inbred corn plants for every male inbred corn plant. In another aspect, a corn field provided herein comprises between 60 and 80 female inbred corn plants for every male inbred corn plant. In another aspect, a corn field provided herein comprises between 80 and 100 female inbred corn plants for every male inbred corn plant. In another aspect, a corn field provided herein comprises between 100 and 120 female inbred corn plants for every male inbred corn plant. In another aspect, a corn field provided herein comprises between 20 and 80 female inbred corn plants for every male inbred corn plant. In another aspect, a corn field provided herein comprises between 40 and 100 female inbred corn plants for every male inbred corn plant. In another aspect, a corn field provided herein comprises between 60 and 120 female inbred corn plants for every male inbred corn plant.

In an aspect, a corn field provided herein comprises a ratio of at least 1 female corn plant for every male corn plant. In another aspect, a corn field provided herein comprises a ratio of at least 2 female corn plants for every male corn plant. In another aspect, a corn field provided herein comprises a ratio of at least 3 female corn plants for every male corn plant. In another aspect, a corn field provided herein comprises a ratio of at least 4 female corn plants for every male corn plant. In another aspect, a corn field provided herein comprises a ratio of at least 5 female corn plants for every male corn plant. In another aspect, a corn field provided herein comprises a ratio of at least 6 female corn plants for every male corn plant. In another aspect, a corn field provided herein comprises a ratio of at least 7 female corn plants for every male corn plant. In another aspect, a corn field provided herein comprises a ratio of at least 8 female corn plants for every male corn plant. In another aspect, a corn field provided herein comprises a ratio of at least 9 female corn plants for every male corn plant. In another aspect, a corn field provided herein comprises a ratio of at least 10 female corn plants for every male corn plant. In another aspect, a corn field provided herein comprises a ratio of at least 15 female corn plants for every male corn plant. In another aspect, a corn field provided herein comprises a ratio of at least 20 female corn plants for every male corn plant. In another aspect, a corn field provided herein comprises a ratio of at least 25 female corn plants for every male corn plant. In another aspect, a corn field provided herein comprises a ratio of at least 30 female corn plants for every male corn plant. In another aspect, a corn field provided herein comprises a ratio of at least 35 female corn plants for every male corn plant. In another aspect, a corn field provided herein comprises a ratio of at least 40 female corn plants for every male corn plant. In another aspect, a corn field provided herein comprises a ratio of at least 45 female corn plants for every male corn plant. In another aspect, a corn field provided herein comprises a ratio of at least 50 female corn plants for every male corn plant. In another aspect, a corn field provided herein comprises a ratio of at least 55 female corn plants for every male corn plant. In another aspect, a corn field provided herein comprises a ratio of at least 60 female corn plants for every male corn plant. In another aspect, a corn field provided herein comprises a ratio of at least 65 female corn plants for every male corn plant. In another aspect, a corn field provided herein comprises a ratio of at least 70 female corn plants for every male corn plant. In another aspect, a corn field provided herein comprises a ratio of at least 75 female corn plants for every male corn plant. In another aspect, a corn field provided herein comprises a ratio of at least 80 female corn plants for every male corn plant. In another aspect, a corn field provided herein comprises a ratio of at least 85 female corn plants for every male corn plant. In another aspect, a corn field provided herein comprises a ratio of at least 90 female corn plants for every male corn plant. In another aspect, a corn field provided herein comprises a ratio of at least 95 female corn plants for every male corn plant. In another aspect, a corn field provided herein comprises a ratio of at least 100 female corn plants for every male corn plant. In another aspect, a corn field provided herein comprises a ratio of at least 105 female corn plants for every male corn plant. In another aspect, a corn field provided herein comprises a ratio of at least 110 female corn plants for every male corn plant. In another aspect, a corn field provided herein comprises a ratio of at least 115 female corn plants for every male corn plant. In another aspect, a corn field provided herein comprises a ratio of at least 120 female corn plants for every male corn plant.

In an aspect, a corn field provided herein comprises between 1 and 10 female corn plants for every male corn plant. In another aspect, a corn field provided herein comprises between 5 and 10 female corn plants for every male corn plant. In another aspect, a corn field provided herein comprises between 1 and 20 female corn plants for every male corn plant. In another aspect, a corn field provided herein comprises between 5 and 20 female corn plants for every male corn plant. In another aspect, a corn field provided herein comprises between 5 and 15 female corn plants for every male corn plant. In another aspect, a corn field provided herein comprises between 5 and 10 female corn plants for every two male corn plants. In another aspect, a corn field provided herein comprises between 5 and 20 female corn plants for every two male corn plants. In another aspect, a corn field provided herein comprises between 5 and 15 female corn plants for every two male corn plants. In another aspect, a corn field provided herein comprises between 1 and 30 female corn plants for every male corn plant. In another aspect, a corn field provided herein comprises between 1 and 40 female corn plants for every male corn plant. In another aspect, a corn field provided herein comprises between 1 and 50 female corn plants for every male corn plant. In another aspect, a corn field provided herein comprises between 1 and 60 female corn plants for every male corn plant. In another aspect, a corn field provided herein comprises between 1 and 80 female corn plants for every male corn plant. In another aspect, a corn field provided herein comprises between 1 and 100 female corn plants for every male corn plant. In another aspect, a corn field provided herein comprises between 1 and 120 female corn plants for every male corn plant. In another aspect, a corn field provided herein comprises between 10 and 20 female corn plants for every male corn plant. In another aspect, a corn field provided herein comprises between 20 and 30 female corn plants for every male corn plant. In another aspect, a corn field provided herein comprises between 30 and 40 female corn plants for every male corn plant. In another aspect, a corn field provided herein comprises between 40 and 50 female corn plants for every male corn plant. In another aspect, a corn field provided herein comprises between 50 and 60 female corn plants for every male corn plant. In another aspect, a corn field provided herein comprises between 60 and 70 female corn plants for every male corn plant. In another aspect, a corn field provided herein comprises between 70 and 80 female corn plants for every male corn plant. In another aspect, a corn field provided herein comprises between 80 and 90 female corn plants for every male corn plant. In another aspect, a corn field provided herein comprises between 90 and 100 female corn plants for every male corn plant. In another aspect, a corn field provided herein comprises between 100 and 110 female corn plants for every male corn plant. In another aspect, a corn field provided herein comprises between 110 and 120 female corn plants for every male corn plant. In another aspect, a corn field provided herein comprises between 20 and 40 female corn plants for every male corn plant. In another aspect, a corn field provided herein comprises between 40 and 60 female corn plants for every male corn plant. In another aspect, a corn field provided herein comprises between 60 and 80 female corn plants for every male corn plant. In another aspect, a corn field provided herein comprises between 80 and 100 female corn plants for every male corn plant. In another aspect, a corn field provided herein comprises between 100 and 120 female corn plants for every male corn plant. In another aspect, a corn field provided herein comprises between 20 and 80 female corn plants for every male corn plant. In another aspect, a corn field provided herein comprises between 40 and 100 female corn plants for every male corn plant. In another aspect, a corn field provided herein comprises between 60 and 120 female corn plants for every male corn plant.

In an aspect, a corn field provided herein comprises at least one row of female inbred corn plants and at least one row of male inbred corn plants. In another aspect, a corn field provided herein comprises multiple rows of female inbred corn plants and at least one row of male inbred corn plants. In another aspect, a corn field provided herein comprises multiple rows of female inbred corn plants and multiple rows of male inbred corn plants.

In an aspect, a corn field provided herein comprises at least one row of female corn plants and at least one row of male corn plants. In another aspect, a corn field provided herein comprises multiple rows of female corn plants and at least one row of male corn plants. In another aspect, a corn field provided herein comprises multiple rows of female corn plants and multiple rows of male corn plants.

In an aspect, a corn field provided herein comprises rows of female inbred corn plants and rows of male inbred corn plants where the overall female-to-male corn plant ratio (or the ratio of female-to-male corn plant rows) within the field is 2:2. In another aspect, a corn field provided herein comprises rows of female inbred corn plants and rows of male inbred corm plants where the overall female-to-male corn plant ratio (or the ratio of female-to-male corn plant rows) within the field is 3:1. In another aspect, a corn field provided herein comprises rows of female inbred corn plants and rows of male inbred corm plants where the overall female-to-male corn plant ratio (or the ratio of female-to-male corn plant rows) within the field is 3:2. In another aspect, a corn field provided herein comprises rows of female inbred corn plants and rows of male inbred corm plants where the overall female-to-male corn plant ratio (or the ratio of female-to-male corn plant rows) within the field is 4:1. In another aspect, a corn field provided herein comprises rows of female inbred corn plants and rows of male inbred corm plants where the overall female-to-male corn plant ratio (or the ratio of female-to-male corn plant rows) within the field is 4:2. In another aspect, a corn field provided herein comprises rows of female inbred corn plants and rows of male inbred corm plants where the overall female-to-male corn plant ratio (or the ratio of female-to-male corn plant rows) within the field is 4:3. In another aspect, a corn field provided herein comprises rows of female inbred corn plants and rows of male inbred corm plants where the overall female-to-male corn plant ratio (or the ratio of female-to-male corn plant rows) within the field is 5:1. In another aspect, a corn field provided herein comprises rows of female inbred corn plants and rows of male inbred corm plants where the overall female-to-male corn plant ratio (or the ratio of female-to-male corn plant rows) within the field is 5:2. In another aspect, a corn field provided herein comprises rows of female inbred corn plants and rows of male inbred corm plants where the overall female-to-male corn plant ratio (or the ratio of female-to-male corn plant rows) within the field is 6:1. In another aspect, a corn field provided herein comprises rows of female inbred corn plants and rows of male inbred corm plants where the overall female-to-male corn plant ratio (or the ratio of female-to-male corn plant rows) within the field is 6:2. In another aspect, a corn field provided herein comprises rows of female inbred corn plants and rows of male inbred corm plants where the overall female-to-male corn plant ratio (or the ratio of female-to-male corn plant rows) within the field is 7:1. In another aspect, a corn field provided herein comprises rows of female inbred corn plants and rows of male inbred corm plants where the overall female-to-male corn plant ratio (or the ratio of female-to-male corn plant rows) within the field is 7:2. In another aspect, a corn field provided herein comprises rows of female inbred corn plants and rows of male inbred corm plants where the overall female-to-male corn plant ratio (or the ratio of female-to-male corn plant rows) within the field is 8:1. In another aspect, a corn field provided herein comprises rows of female inbred corn plants and rows of male inbred corm plants where the overall female-to-male corn plant ratio (or the ratio of female-to-male corn plant rows) within the field is 8:2.

In an aspect, a corn field provided herein comprises rows of female corn plants and rows of male corn plants where the overall female-to-male corn plant ratio (or the ratio of female-to-male corn plant rows) within the field is 2:2. In another aspect, a corn field provided herein comprises rows of female inbred corn plants and rows of male inbred corm plants where the overall female-to-male corn plant ratio (or the ratio of female-to-male corn plant rows) within the field is 3:1. In another aspect, a corn field provided herein comprises rows of female corn plants and rows of male corm plants where the overall female-to-male corn plant ratio (or the ratio of female-to-male corn plant rows) within the field is 3:2. In another aspect, a corn field provided herein comprises rows of female corn plants and rows of male corm plants where the overall female-to-male corn plant ratio (or the ratio of female-to-male corn plant rows) within the field is 4:1. In another aspect, a corn field provided herein comprises rows of female corn plants and rows of male corm plants where the overall female-to-male corn plant ratio (or the ratio of female-to-male corn plant rows) within the field is 4:2. In another aspect, a corn field provided herein comprises rows of female corn plants and rows of male corm plants where the overall female-to-male corn plant ratio (or the ratio of female-to-male corn plant rows) within the field is 4:3. In another aspect, a corn field provided herein comprises rows of female corn plants and rows of male corm plants where the overall female-to-male corn plant ratio (or the ratio of female-to-male corn plant rows) within the field is 5:1. In another aspect, a corn field provided herein comprises rows of female corn plants and rows of male corm plants where the overall female-to-male corn plant ratio (or the ratio of female-to-male corn plant rows) within the field is 5:2. In another aspect, a corn field provided herein comprises rows of female corn plants and rows of male corm plants where the overall female-to-male corn plant ratio (or the ratio of female-to-male corn plant rows) within the field is 6:1. In another aspect, a corn field provided herein comprises rows of female corn plants and rows of male corm plants where the overall female-to-male corn plant ratio (or the ratio of female-to-male corn plant rows) within the field is 6:2. In another aspect, a corn field provided herein comprises rows of female corn plants and rows of male corm plants where the overall female-to-male corn plant ratio (or the ratio of female-to-male corn plant rows) within the field is 7:1. In another aspect, a corn field provided herein comprises rows of female corn plants and rows of male corm plants where the overall female-to-male corn plant ratio (or the ratio of female-to-male corn plant rows) within the field is 7:2. In another aspect, a corn field provided herein comprises rows of female corn plants and rows of male corm plants where the overall female-to-male corn plant ratio (or the ratio of female-to-male corn plant rows) within the field is 8:1. In another aspect, a corn field provided herein comprises rows of female corn plants and rows of male corm plants where the overall female-to-male corn plant ratio (or the ratio of female-to-male corn plant rows) within the field is 8:2.

In an aspect, a corn field provided herein comprises at least 1 female corn plant row for every male corn plant row. In another aspect, a corn field provided herein comprises at least 2 female corn plant rows for every male corn plant row. In another aspect, a corn field provided herein comprises at least 3 female corn plant rows for every male corn plant row. In another aspect, a corn field provided herein comprises at least 4 female corn plant rows for every male corn plant row. In another aspect, a corn field provided herein comprises at least 5 female corn plant rows for every male corn plant row. In another aspect, a corn field provided herein comprises at least 6 female corn plant rows for every male corn plant row. In another aspect, a corn field provided herein comprises at least 7 female corn plant rows for every male corn plant row. In another aspect, a corn field provided herein comprises at least 8 female corn plant rows for every male corn plant row. In another aspect, a corn field provided herein comprises at least 9 female corn plant rows for every male corn plant row. In another aspect, a corn field provided herein comprises at least 10 female corn plant rows for every male corn plant row. In another aspect, a corn field provided herein comprises at least 11 female corn plant rows for every male corn plant row. In another aspect, a corn field provided herein comprises at least 12 female corn plant rows for every male corn plant row.

In an aspect, a corn field provided herein comprises between 1 female row and 2 female rows for every male row. In another aspect, a corn field provided herein comprises between 2 female rows and 3 female rows for every male row. In another aspect, a corn field provided herein comprises between 3 female rows and 4 female rows for every male row. In another aspect, a corn field provided herein comprises between 4 female rows and 5 female rows for every male row. In another aspect, a corn field provided herein comprises between 5 female rows and 6 female rows for every male row. In another aspect, a corn field provided herein comprises between 6 female rows and 7 female rows for every male row. In another aspect, a corn field provided herein comprises between 7 female rows and 8 female rows for every male row. In another aspect, a corn field provided herein comprises between 8 female rows and 9 female rows for every male row. In another aspect, a corn field provided herein comprises between 9 female rows and 10 female rows for every male row. In another aspect, a corn field provided herein comprises between 10 female rows and 11 female rows for every male row. In another aspect, a corn field provided herein comprises between 11 female rows and 12 female rows for every male row. In another aspect, a corn field provided herein comprises between 1 female row and 4 female rows for every male row. In another aspect, a corn field provided herein comprises between 4 female rows and 8 female rows for every male row. In another aspect, a corn field provided herein comprises between 8 female rows and 12 female rows for every male row. In another aspect, a corn field provided herein comprises between 1 female row and 10 female rows for every male row. In another aspect, a corn field provided herein comprises between 1 female row and 12 female rows for every male row.

In an aspect, a corn field provided herein comprises a regular and repeating pattern of two contiguous rows of female corn plants followed by two contiguous rows of male corn plants. In an aspect, a corn field provided herein comprises a regular and repeating pattern of three contiguous rows of female corn plants followed by one row of male corn plants. In an aspect, a corn field provided herein comprises a regular and repeating pattern of three contiguous rows of female corn plants followed by two rows of male corn plants. In an aspect, a corn field provided herein comprises a regular and repeating pattern of four contiguous rows of female corn plants followed by one row of male corn plants. In an aspect, a corn field provided herein comprises a regular and repeating pattern of four contiguous rows of female corn plants followed by two contiguous rows of male corn plants. In an aspect, a corn field provided herein comprises a regular and repeating pattern of four contiguous rows of female corn plants followed by three contiguous rows of male corn plants. In an aspect, a corn field provided herein comprises a regular and repeating pattern of five contiguous rows of female corn plants followed by one row of male corn plants. In an aspect, a corn field provided herein comprises a regular and repeating pattern of five contiguous rows of female corn plants followed by two contiguous rows of male corn plants. In an aspect, a corn field provided herein comprises a regular and repeating pattern of six contiguous rows of female corn plants followed by one row of male corn plants. In an aspect, a corn field provided herein comprises a regular and repeating pattern of six contiguous rows of female corn plants followed by two contiguous rows of male corn plants. In an aspect, a corn field provided herein comprises a regular and repeating pattern of seven contiguous rows of female corn plants followed by one row of male corn plants. In an aspect, a corn field provided herein comprises a regular and repeating pattern of seven contiguous rows of female corn plants followed by two contiguous rows of male corn plants. In an aspect, a corn field provided herein comprises a regular and repeating pattern of eight contiguous rows of female corn plants followed by one row of male corn plants. In an aspect, a corn field provided herein comprises a regular and repeating pattern of eight contiguous rows of female corn plants followed by two contiguous rows of male corn plants.

In an aspect, a corn field provided herein comprises at least two rows of corn plants, where any two adjacent rows are spaced at least 10 inches apart. In another aspect, a corn field provided herein comprises at least two rows of corn plants, where any two adjacent rows are spaced at least 12 inches apart. In another aspect, a corn field provided herein comprises at least two rows of corn plants, where any two adjacent rows are spaced at least 14 inches apart. In another aspect, a corn field provided herein comprises at least two rows of corn plants, where any two adjacent rows are spaced at least 16 inches apart. In another aspect, a corn field provided herein comprises at least two rows of corn plants, where any two adjacent rows are spaced at least 18 inches apart. In another aspect, a corn field provided herein comprises at least two rows of corn plants, where any two adjacent rows are spaced at least 20 inches apart. In another aspect, a corn field provided herein comprises at least two rows of corn plants, where any two adjacent rows are spaced at least 22 inches apart. In another aspect, a corn field provided herein comprises at least two rows of corn plants, where any two adjacent rows are spaced at least 24 inches apart. In another aspect, a corn field provided herein comprises at least two rows of corn plants, where any two adjacent rows are spaced at least 26 inches apart. In another aspect, a corn field provided herein comprises at least two rows of corn plants, where any two adjacent rows are spaced at least 28 inches apart. In another aspect, a corn field provided herein comprises at least two rows of corn plants, where any two adjacent rows are spaced at least 30 inches apart. In another aspect, a corn field provided herein comprises at least two rows of corn plants, where any two adjacent rows are spaced at least 32 inches apart. In another aspect, a corn field provided herein comprises at least two rows of corn plants, where any two adjacent rows are spaced at least 34 inches apart. In another aspect, a corn field provided herein comprises at least two rows of corn plants, where any two adjacent rows are spaced at least 36 inches apart. In another aspect, a corn field provided herein comprises at least two rows of corn plants, where any two adjacent rows are spaced at least 38 inches apart. In another aspect, a corn field provided herein comprises at least two rows of corn plants, where any two adjacent rows are spaced at least 40 inches apart. In another aspect, a corn field provided herein comprises at least two rows of corn plants, where different adjacent rows of the corn field have variable and/or irregular spacing.

In an aspect, a corn field provided herein comprises an average of at least 10 inches between adjacent rows of corn plants. In an aspect, a corn field provided herein comprises an average of at least 12 inches between adjacent rows of corn plants. In an aspect, a corn field provided herein comprises an average of at least 14 inches between adjacent rows of corn plants. In an aspect, a corn field provided herein comprises an average of at least 16 inches between adjacent rows of corn plants. In an aspect, a corn field provided herein comprises an average of at least 18 inches between adjacent rows of corn plants. In an aspect, a corn field provided herein comprises an average of at least 20 inches between adjacent rows of corn plants. In an aspect, a corn field provided herein comprises an average of at least 22 inches between adjacent rows of corn plants. In an aspect, a corn field provided herein comprises an average of at least 24 inches between adjacent rows of corn plants. In an aspect, a corn field provided herein comprises an average of at least 26 inches between adjacent rows of corn plants. In an aspect, a corn field provided herein comprises an average of at least 28 inches between adjacent rows of corn plants. In an aspect, a corn field provided herein comprises an average of at least 30 inches between adjacent rows of corn plants. In an aspect, a corn field provided herein comprises an average of at least 32 inches between adjacent rows of corn plants. In an aspect, a corn field provided herein comprises an average of at least 34 inches between adjacent rows of corn plants. In an aspect, a corn field provided herein comprises an average of at least 36 inches between adjacent rows of corn plants. In an aspect, a corn field provided herein comprises an average of at least 38 inches between adjacent rows of corn plants. In an aspect, a corn field provided herein comprises an average of at least 40 inches between adjacent rows of corn plants.

In an aspect, a corn field provided herein comprises at least two rows of corn plants, where any two adjacent rows are spaced between 10 and 12 inches apart. In another aspect, a corn field provided herein comprises at least two rows of corn plants, where any two adjacent rows are spaced between 12 and 14 inches apart. In another aspect, a corn field provided herein comprises at least two rows of corn plants, where any two adjacent rows are spaced between 14 and 16 inches apart. In another aspect, a corn field provided herein comprises at least two rows of corn plants, where any two adjacent rows are spaced between 16 and 18 inches apart. In another aspect, a corn field provided herein comprises at least two rows of corn plants, where any two adjacent rows are spaced between 18 and 20 inches apart. In another aspect, a corn field provided herein comprises at least two rows of corn plants, where any two adjacent rows are spaced between 20 and 22 inches apart. In another aspect, a corn field provided herein comprises at least two rows of corn plants, where any two adjacent rows are spaced between 22 and 24 inches apart. In another aspect, a corn field provided herein comprises at least two rows of corn plants, where any two adjacent rows are spaced between 24 and 26 inches apart. In another aspect, a corn field provided herein comprises at least two rows of corn plants, where any two adjacent rows are spaced between 26 and 28 inches apart. In another aspect, a corn field provided herein comprises at least two rows of corn plants, where any two adjacent rows are spaced between 28 and 30 inches apart. In another aspect, a corn field provided herein comprises at least two rows of corn plants, where any two adjacent rows are spaced between 30 and 32 inches apart. In another aspect, a corn field provided herein comprises at least two rows of corn plants, where any two adjacent rows are spaced between 32 and 34 inches apart. In another aspect, a corn field provided herein comprises at least two rows of corn plants, where any two adjacent rows are spaced between 34 and 36 inches apart. In another aspect, a corn field provided herein comprises at least two rows of corn plants, where any two adjacent rows are spaced between 36 and 38 inches apart. In another aspect, a corn field provided herein comprises at least two rows of corn plants, where any two adjacent rows are spaced between 38 and 40 inches apart. In another aspect, a corn field provided herein comprises at least two rows of corn plants, where any two adjacent rows are spaced between 10 and 15 inches apart. In another aspect, a corn field provided herein comprises at least two rows of corn plants, where any two adjacent rows are spaced between 15 and 20 inches apart. In another aspect, a corn field provided herein comprises at least two rows of corn plants, where any two adjacent rows are spaced between 20 and 25 inches apart. In another aspect, a corn field provided herein comprises at least two rows of corn plants, where any two adjacent rows are spaced between 25 and 30 inches apart. In another aspect, a corn field provided herein comprises at least two rows of corn plants, where any two adjacent rows are spaced between 30 and 35 inches apart. In another aspect, a corn field provided herein comprises at least two rows of corn plants, where any two adjacent rows are spaced between 35 and 40 inches apart. In another aspect, a corn field provided herein comprises at least two rows of corn plants, where any two adjacent rows are spaced between 12 and 24 inches apart. In another aspect, a corn field provided herein comprises at least two rows of corn plants, where any two adjacent rows are spaced between 24 and 36 inches apart. In another aspect, a corn field provided herein comprises at least two rows of corn plants, where any two adjacent rows are spaced between 12 and 36 inches apart. In another aspect, a corn field provided herein comprises at least two rows of corn plants, where any two adjacent rows are spaced between 10 and 40 inches apart.

In an aspect, a corn field provided herein comprises an average of between 10 and 12 inches between adjacent rows of corn plants. In an aspect, a corn field provided herein comprises an average of between 10 and 14 inches between adjacent rows of corn plants. In an aspect, a corn field provided herein comprises an average of between 10 and 16 inches between adjacent rows of corn plants. In an aspect, a corn field provided herein comprises an average of between 10 and 18 inches between adjacent rows of corn plants. In an aspect, a corn field provided herein comprises an average of between 10 and 20 inches between adjacent rows of corn plants. In an aspect, a corn field provided herein comprises an average of between 10 and 22 inches between adjacent rows of corn plants. In an aspect, a corn field provided herein comprises an average of between 10 and 24 inches between adjacent rows of corn plants. In an aspect, a corn field provided herein comprises an average of between 10 and 26 inches between adjacent rows of corn plants. In an aspect, a corn field provided herein comprises an average of between 10 and 28 inches between adjacent rows of corn plants. In an aspect, a corn field provided herein comprises an average of between 10 and 30 inches between adjacent rows of corn plants. In an aspect, a corn field provided herein comprises an average of between 10 and 32 inches between adjacent rows of corn plants. In an aspect, a corn field provided herein comprises an average of between 10 and 34 inches between adjacent rows of corn plants. In an aspect, a corn field provided herein comprises an average of between 10 and 36 inches between adjacent rows of corn plants. In an aspect, a corn field provided herein comprises an average of between 10 and 38 inches between adjacent rows of corn plants. In an aspect, a corn field provided herein comprises an average of between 10 and 40 inches between adjacent rows of corn plants. In an aspect, a corn field provided herein comprises an average of between 12 and 18 inches between adjacent rows of corn plants. In an aspect, a corn field provided herein comprises an average of between 12 and 20 inches between adjacent rows of corn plants. In an aspect, a corn field provided herein comprises an average of between 12 and 22 inches between adjacent rows of corn plants. In an aspect, a corn field provided herein comprises an average of between 12 and 24 inches between adjacent rows of corn plants. In an aspect, a corn field provided herein comprises an average of between 12 and 36 inches between adjacent rows of corn plants. In an aspect, a corn field provided herein comprises an average of between 18 and 24 inches between adjacent rows of corn plants. In an aspect, a corn field provided herein comprises an average of between 18 and 36 inches between adjacent rows of corn plants.

As used herein, the term "harvesting" refers to the process of removing or gathering at least one ear of corn from a corn plant. A corn field is considered to be "harvested" when at least one ear has been removed from at least 50% of the corn plants in the corn field. As such, an "unharvested" corn plant has not had any ears purposely removed. In an aspect, a corn field provided herein is an unharvested corn field. In another aspect, at least 50% of the corn plants in a corn field provided herein are unharvested. In another aspect, at least 60% of the corn plants in a corn field provided herein are unharvested. In another aspect, at least 70% of the inbred corn plants in a corn field provided herein are unharvested. In another aspect, at least 80% of the corn plants in a corn field provided herein are unharvested. In another aspect, at least 90% of the corn plants in a corn field provided herein are unharvested. In another aspect, 100% of the corn plants in a corn field provided herein are unharvested.

As used herein, the term "yield" refers to the amount of harvested plant material, such as kernels or seeds, per harvested field or cultivated area. In an aspect, yield is measured in bushels per acre. Yield can be dependent on average kernel weight and the average number of kernels per ear. As used herein, "seed yield" refers to the number of seeds or kernels harvested per harvested field or cultivated area. In an aspect, seed yield is measured in Standard Seed Units (SSU) per acre. One SSU for corn is equivalent to 80,000 corn seed kernels. In an aspect, seed yield is measured in terms of the average number of kernels or seeds per ear. The number of Standard Seed Units (SSUs) or the average number of kernels per ear is/are appropriate for seed production since they quantify the number of seeds or kernels that can be produced, harvested or collected from a seed production field or from female corn plant(s), and thus the number of hybrid corn seeds or kernels that can potentially be sold and planted from the quantity of seeds or kernels produced, whereas yield takes into account both seed number and seed size.

In an aspect, the yield of hybrid corn seed provided herein comprises an average of at least 60 bushels per acre. In an aspect, the yield of hybrid corn seed provided herein comprises an average of at least 80 bushels per acre. In an aspect, the yield of hybrid corn seed provided herein comprises an average of at least 100 bushels per acre. In another aspect, the yield of hybrid corn seed provided herein comprises an average of at least 120 bushels per acre. In another aspect, the yield of hybrid corn seed provided herein comprises an average of at least 140 bushels per acre. In another aspect, the yield of hybrid corn seed provided herein comprises an average of at least 160 bushels per acre. In another aspect, the yield of hybrid corn seed provided herein comprises an average of at least 180 bushels per acre. In another aspect, the yield of hybrid corn seed provided herein comprises an average of at least 200 bushels per acre. In another aspect, the yield of hybrid corn seed provided herein comprises an average of at least 220 bushels per acre. In another aspect, the yield of hybrid corn seed provided herein comprises an average of at least 240 bushels per acre. In another aspect, the yield of hybrid corn seed provided herein comprises an average of at least 260 bushels per acre. In another aspect, the yield of hybrid corn seed provided herein comprises an average of at least 300 bushels per acre. In another aspect, the yield of hybrid corn seed provided herein comprises an average of at least 400 bushels per acre. In another aspect, the yield of hybrid corn seed provided herein comprises an average of at least 500 bushels per acre.

In an aspect, the yield of hybrid corn seed provided herein comprises an average of between 100 and 120 bushels per acre. In another aspect, the yield of hybrid corn seed provided herein comprises an average of between 120 and 140 bushels per acre. In another aspect, the yield of hybrid corn seed provided herein comprises an average of between 140 and 160 bushels per acre. In another aspect, the yield of hybrid corn seed provided herein comprises an average of between 160 and 180 bushels per acre. In another aspect, the yield of hybrid corn seed provided herein comprises an average of between 180 and 200 bushels per acre. In another aspect, the yield of hybrid corn seed provided herein comprises an average of between 200 and 220 bushels per acre. In another aspect, the yield of hybrid corn seed provided herein comprises an average of between 220 and 240 bushels per acre. In another aspect, the yield of hybrid corn seed provided herein comprises an average of between 240 and 260 bushels per acre. In another aspect, the yield of hybrid corn seed provided herein comprises an average of between 100 and 140 bushels per acre. In another aspect, the yield of hybrid corn seed provided herein comprises an average of between 140 and 180 bushels per acre. In another aspect, the yield of hybrid corn seed provided herein comprises an average of between 180 and 220 bushels per acre. In another aspect, the yield of hybrid corn seed provided herein comprises an average of between 220 and 260 bushels per acre. In another aspect, the yield of hybrid corn seed provided herein comprises an average of between 100 and 180 bushels per acre. In another aspect, the yield of hybrid corn seed provided herein comprises an average of between 180 and 260 bushels per acre. In another aspect, the yield of hybrid corn seed provided herein comprises an average of between 100 and 500 bushels per acre. In another aspect, the yield of hybrid corn seed provided herein comprises an average of between 100 and 400 bushels per acre. In another aspect, the yield of hybrid corn seed provided herein comprises an average of between 100 and 350 bushels per acre. In another aspect, the yield of hybrid corn seed provided herein comprises an average of between 100 and 300 bushels per acre. In another aspect, the yield of hybrid corn seed provided herein comprises an average of between 100 and 260 bushels per acre. In another aspect, the yield of hybrid corn seed provided herein comprises an average of between 100 and 200 bushels per acre.

In an aspect, the yield of hybrid corn seed provided herein comprises at least 100 bushels per acre. In another aspect, the yield of hybrid corn seed provided herein comprises at least 120 bushels per acre. In another aspect, the yield of hybrid corn seed provided herein comprises at least 140 bushels per acre. In another aspect, the yield of hybrid corn seed provided herein comprises at least 160 bushels per acre. In another aspect, the yield of hybrid corn seed provided herein comprises at least 180 bushels per acre. In another aspect, the yield of hybrid corn seed provided herein comprises at least 200 bushels per acre. In another aspect, the yield of hybrid corn seed provided herein comprises at least 220 bushels per acre. In another aspect, the yield of hybrid corn seed provided herein comprises at least 240 bushels per acre. In another aspect, the yield of hybrid corn seed provided herein comprises at least 260 bushels per acre. In another aspect, the yield of hybrid corn seed provided herein comprises at least 300 bushels per acre. In another aspect, the yield of hybrid corn seed provided herein comprises at least 350 bushels per acre. In another aspect, the yield of hybrid corn seed provided herein comprises at least 400 bushels per acre. In another aspect, the yield of hybrid corn seed provided herein comprises at least 450 bushels per acre. In another aspect, the yield of hybrid corn seed provided herein comprises at least 500 bushels per acre.

In an aspect, the yield of hybrid corn seed provided herein comprises between 100 and 120 bushels per acre. In another aspect, the yield of hybrid corn seed provided herein comprises between 120 and 140 bushels per acre. In another aspect, the yield of hybrid corn seed provided herein comprises between 140 and 160 bushels per acre. In another aspect, the yield of hybrid corn seed provided herein comprises between 160 and 180 bushels per acre. In another aspect, the yield of hybrid corn seed provided herein comprises between 180 and 200 bushels per acre. In another aspect, the yield of hybrid corn seed provided herein comprises between 200 and 220 bushels per acre. In another aspect, the yield of hybrid corn seed provided herein comprises between 220 and 240 bushels per acre. In another aspect, the yield of hybrid corn seed provided herein comprises between 240 and 260 bushels per acre. In another aspect, the yield of hybrid corn seed provided herein comprises between 100 and 140 bushels per acre. In another aspect, the yield of hybrid corn seed provided herein comprises between 140 and 180 bushels per acre. In another aspect, the yield of hybrid corn seed provided herein comprises between 180 and 220 bushels per acre. In another aspect, the yield of hybrid corn seed provided herein comprises between 220 and 260 bushels per acre. In another aspect, the yield of hybrid corn seed provided herein comprises between 100 and 180 bushels per acre. In another aspect, the yield of hybrid corn seed provided herein comprises between 180 and 260 bushels per acre. In another aspect, the yield of hybrid corn seed provided herein comprises between 100 and 500 bushels per acre. In another aspect, the yield of hybrid corn seed provided herein comprises between 100 and 450 bushels per acre. In another aspect, the yield of hybrid corn seed provided herein comprises between 100 and 400 bushels per acre. In another aspect, the yield of hybrid corn seed provided herein comprises between 100 and 350 bushels per acre. In another aspect, the yield of hybrid corn seed provided herein comprises between 100 and 300 bushels per acre. In another aspect, the yield of hybrid corn seed provided herein comprises between 100 and 260 bushels per acre. In another aspect, the yield of hybrid corn seed provided herein comprises between 100 and 200 bushels per acre.

In an aspect, the hybrid corn seed yield provided herein comprises an average of at least 200 kernels per ear. In another aspect, the hybrid corn seed yield provided herein comprises an average of at least 300 kernels per ear. In another aspect, the hybrid corn seed yield provided herein comprises an average of at least 400 kernels per ear. In another aspect, the hybrid corn seed yield provided herein comprises an average of at least 500 kernels per ear. In another aspect, the hybrid corn seed yield provided herein comprises an average of at least 600 kernels per ear. In another aspect, the hybrid corn seed yield provided herein comprises an average of at least 700 kernels per ear. In another aspect, the hybrid corn seed yield provided herein comprises an average of at least 800 kernels per ear. In another aspect, the hybrid corn seed yield provided herein comprises an average of at least 900 kernels per ear. In another aspect, the hybrid corn seed yield provided herein comprises an average of at least 1,000 kernels per ear. In another aspect, the hybrid corn seed yield provided herein comprises an average of at least 1,100 kernels per ear. In another aspect, the hybrid corn seed yield provided herein comprises an average of at least 1,200 kernels per ear. In another aspect, the hybrid corn seed yield provided herein comprises an average of at least 1,300 kernels per ear. In another aspect, the hybrid corn seed yield provided herein comprises an average of at least 1,400 kernels per ear. In another aspect, the hybrid corn seed yield provided herein comprises an average of at least 1,500 kernels per ear.

In an aspect, the hybrid corn seed yield provided herein comprises an average of between 200 and 300 kernels per ear. In another aspect, the hybrid corn seed yield provided herein comprises an average of between 300 and 400 kernels per ear. In another aspect, the hybrid corn seed yield provided herein comprises an average of between 400 and 500 kernels per ear. In another aspect, the hybrid corn seed yield provided herein comprises an average of between 500 and 600 kernels per ear. In another aspect, the hybrid corn seed yield provided herein comprises an average of between 600 and 700 kernels per ear. In another aspect, the hybrid corn seed yield provided herein comprises an average of between 700 and 800 kernels per ear. In another aspect, the hybrid corn seed yield provided herein comprises an average of between 800 and 900 kernels per ear. In another aspect, the hybrid corn seed yield provided herein comprises an average of between 900 and 1,000 kernels per ear. In another aspect, the hybrid corn seed yield provided herein comprises an average of between 1,000 and 1,100 kernels per ear. In another aspect, the hybrid corn seed yield provided herein comprises an average of between 1,100 and 1,200 kernels per ear. In another aspect, the hybrid corn seed yield provided herein comprises an average of between 200 and 400 kernels per ear. In another aspect, the hybrid corn seed yield provided herein comprises an average of between 400 and 600 kernels per ear. In another aspect, the hybrid corn seed yield provided herein comprises an average of between 600 and 800 kernels per ear. In another aspect, the hybrid corn seed yield provided herein comprises an average of between 800 and 1,000 kernels per ear. In another aspect, the hybrid corn seed yield provided herein comprises an average of between 1,000 and 1,200 kernels per ear. In another aspect, the hybrid corn seed yield provided herein comprises an average of between 200 and 700 kernels per ear. In another aspect, the hybrid corn seed yield provided herein comprises an average of between 700 and 1,200 kernels per ear. In another aspect, the hybrid corn seed yield provided herein comprises an average of between 200 and 1,500 kernels per ear. In another aspect, the hybrid corn seed yield provided herein comprises an average of between 200 and 1,400 kernels per ear. In another aspect, the hybrid corn seed yield provided herein comprises an average of between 200 and 1,300 kernels per ear. In another aspect, the hybrid corn seed yield provided herein comprises an average of between 200 and 1,200 kernels per ear.

In an aspect, the hybrid corn seed yield provided herein comprises at least 200 kernels per ear. In another aspect, the hybrid corn seed yield provided herein comprises at least 300 kernels per ear. In another aspect, the hybrid corn seed yield provided herein comprises at least 400 kernels per ear. In another aspect, the hybrid corn seed yield provided herein comprises at least 500 kernels per ear. In another aspect, the hybrid corn seed yield provided herein comprises at least 600 kernels per ear. In another aspect, the hybrid corn seed yield provided herein comprises at least 700 kernels per ear. In another aspect, the hybrid corn seed yield provided herein comprises at least 800 kernels per ear. In another aspect, the hybrid corn seed yield provided herein comprises at least 900 kernels per ear. In another aspect, the hybrid corn seed yield provided herein comprises at least 1,000 kernels per ear. In another aspect, the hybrid corn seed yield provided herein comprises at least 1,100 kernels per ear. In another aspect, the hybrid corn seed yield provided herein comprises at least 1,200 kernels per ear. In another aspect, the hybrid corn seed yield provided herein comprises at least 1,300 kernels per ear. In another aspect, the hybrid corn seed yield provided herein comprises at least 1,400 kernels per ear. In another aspect, the hybrid corn seed yield provided herein comprises at least 1,500 kernels per ear.

In an aspect, the hybrid corn seed yield provided herein comprises between 200 and 300 kernels per ear. In another aspect, the hybrid corn seed yield provided herein comprises between 300 and 400 kernels per ear. In another aspect, the hybrid corn seed yield provided herein comprises between 400 and 500 kernels per ear. In another aspect, the hybrid corn seed yield provided herein comprises between 500 and 600 kernels per ear. In another aspect, the hybrid corn seed yield provided herein comprises between 600 and 700 kernels per ear. In another aspect, the hybrid corn seed yield provided herein comprises between 700 and 800 kernels per ear. In another aspect, the hybrid corn seed yield provided herein comprises between 800 and 900 kernels per ear. In another aspect, the hybrid corn seed yield provided herein comprises between 900 and 1,000 kernels per ear. In another aspect, the hybrid corn seed yield provided herein comprises between 1,000 and 1,100 kernels per ear. In another aspect, the hybrid corn seed yield provided herein comprises between 1,100 and 1,200 kernels per ear. In another aspect, the hybrid corn seed yield provided herein comprises between 200 and 400 kernels per ear. In another aspect, the hybrid corn seed yield provided herein comprises between 400 and 600 kernels per ear. In another aspect, the hybrid corn seed yield provided herein comprises between 600 and 800 kernels per ear. In another aspect, the hybrid corn seed yield provided herein comprises between 800 and 1,000 kernels per ear. In another aspect, the hybrid corn seed yield provided herein comprises between 1,000 and 1,200 kernels per ear. In another aspect, the hybrid corn seed yield provided herein comprises between 200 and 700 kernels per ear. In another aspect, the hybrid corn seed yield provided herein comprises between 700 and 1,200 kernels per ear. In another aspect, the hybrid corn seed yield provided herein comprises between 200 and 1,200 kernels per ear.

In an aspect, the hybrid corn seed provided herein comprises an average of at least 0.2 grams per dry kernel. In another aspect, the hybrid corn seed provided herein comprises an average of at least 0.25 grams per dry kernel. In another aspect, the hybrid corn seed provided herein comprises an average of at least 0.3 grams per dry kernel. In another aspect, the hybrid corn seed provided herein comprises an average of at least 0.35 grams per dry kernel. In another aspect, the hybrid corn seed provided herein comprises an average of at least 0.4 grams per dry kernel. In another aspect, the hybrid corn seed provided herein comprises an average of at least 0.45 grams per dry kernel. In another aspect, the hybrid corn seed provided herein comprises an average of at least 0.5 grams per dry kernel. In another aspect, the hybrid corn seed provided herein comprises an average of at least 0.55 grams per dry kernel. In another aspect, the hybrid corn seed provided herein comprises an average of at least 0.6 grams per dry kernel.

In an aspect, the hybrid corn seed provided herein comprises an average of between 0.2 and 0.25 grams per dry kernel. In another aspect, the hybrid corn seed provided herein comprises an average of between 0.25 and 0.3 grams per dry kernel. In another aspect, the hybrid corn seed provided herein comprises an average of between 0.3 and 0.35 grams per dry kernel. In another aspect, the hybrid corn seed provided herein comprises an average of between 0.35 and 0.4 grams per dry kernel. In another aspect, the hybrid corn seed provided herein comprises an average of between 0.4 and 0.45 grams per dry kernel. In another aspect, the hybrid corn seed provided herein comprises an average of between 0.45 and 0.5 grams per dry kernel. In another aspect, the hybrid corn seed provided herein comprises an average of between 0.5 and 0.55 grams per dry kernel. In another aspect, the hybrid corn seed provided herein comprises an average of between 0.55 and 0.6 grams per dry kernel. In another aspect, the hybrid corn seed provided herein comprises an average of between 0.2 and 0.3 grams per dry kernel. In another aspect, the hybrid corn seed provided herein comprises an average of between 0.3 and 0.4 grams per dry kernel. In another aspect, the hybrid corn seed provided herein comprises an average of between 0.4 and 0.5 grams per dry kernel. In another aspect, the hybrid corn seed provided herein comprises an average of between 0.5 and 0.6 grams per dry kernel. In another aspect, the hybrid corn seed provided herein comprises an average of between 0.2 and 0.4 grams per dry kernel. In another aspect, the hybrid corn seed provided herein comprises an average of between 0.4 and 0.6 grams per dry kernel. In another aspect, the hybrid corn seed provided herein comprises an average of between 0.2 and 0.6 grams per dry kernel.

In an aspect, the hybrid corn seed provided herein comprises at least 0.2 grams per dry kernel. In another aspect, the hybrid corn seed provided herein comprises at least 0.25 grams per dry kernel. In another aspect, the hybrid corn seed provided herein comprises at least 0.3 grams per dry kernel. In another aspect, the hybrid corn seed provided herein comprises at least 0.35 grams per dry kernel. In another aspect, the yield corn seed provided herein comprises at least 0.4 grams per dry kernel. In another aspect, the hybrid corn seed provided herein comprises at least 0.45 grams per dry kernel. In another aspect, the hybrid corn seed provided herein comprises at least 0.5 grams per dry kernel. In another aspect, the hybrid corn seed provided herein comprises at least 0.55 grams per dry kernel. In another aspect, the hybrid corn seed provided herein comprises at least 0.6 grams per dry kernel.

In an aspect, the hybrid corn seed provided herein comprises between 0.2 and 0.25 grams per dry kernel. In another aspect, the hybrid corn seed provided herein comprises between 0.25 and 0.3 grams per dry kernel. In another aspect, the hybrid corn seed provided herein comprises between 0.3 and 0.35 grams per dry kernel. In another aspect, the hybrid corn seed provided herein comprises between 0.35 and 0.4 grams per dry kernel. In another aspect, the hybrid corn seed provided herein comprises between 0.4 and 0.45 grams per dry kernel. In another aspect, the hybrid corn seed provided herein comprises between 0.45 and 0.5 grams per dry kernel. In another aspect, the hybrid corn seed provided herein comprises between 0.5 and 0.55 grams per dry kernel. In another aspect, the hybrid corn seed provided herein comprises between 0.55 and 0.6 grams per dry kernel. In another aspect, the hybrid corn seed provided herein comprises between 0.2 and 0.3 grams per dry kernel. In another aspect, the hybrid corn seed provided herein comprises between 0.3 and 0.4 grams per dry kernel. In another aspect, the hybrid corn seed provided herein comprises between 0.4 and 0.5 grams per dry kernel. In another aspect, the hybrid corn seed provided herein comprises between 0.5 and 0.6 grams per dry kernel. In another aspect, the hybrid corn seed provided herein comprises between 0.2 and 0.4 grams per dry kernel. In another aspect, the hybrid corn seed provided herein comprises between 0.4 and 0.6 grams per dry kernel. In another aspect, the hybrid corn seed provided herein comprises between 0.2 and 0.6 grams per dry kernel.

In an aspect, the yield of hybrid corn seed provided herein comprises at least 80 SSUs per acre. In an aspect, the yield of hybrid corn seed provided herein comprises at least 90 SSUs per acre. In an aspect, the yield of hybrid corn seed provided herein comprises at least 100 SSUs per acre. In an aspect, the yield of hybrid corn seed provided herein comprises at least 105 SSUs per acre. In an aspect, the yield of hybrid corn seed provided herein comprises at least 110 SSUs per acre. In an aspect, the yield of hybrid corn seed provided herein comprises at least 115 SSUs per acre. In an aspect, the yield of hybrid corn seed provided herein comprises at least 120 SSUs per acre. In an aspect, the yield of hybrid corn seed provided herein comprises at least 125 SSUs per acre. In an aspect, the yield of hybrid corn seed provided herein comprises at least 130 SSUs per acre. In an aspect, the yield of hybrid corn seed provided herein comprises at least 135 SSUs per acre. In an aspect, the yield of hybrid corn seed provided herein comprises at least 140 SSUs per acre. In an aspect, the yield of hybrid corn seed provided herein comprises at least 145 SSUs per acre. In an aspect, the yield of hybrid corn seed provided herein comprises at least 150 SSUs per acre. In an aspect, the yield of hybrid corn seed provided herein comprises at least 155 SSUs per acre. In an aspect, the yield of hybrid corn seed provided herein comprises at least 160 SSUs per acre. In an aspect, the yield of hybrid corn seed provided herein comprises at least 170 SSUs per acre. In an aspect, the yield of hybrid corn seed provided herein comprises at least 180 SSUs per acre. In an aspect, the yield of hybrid corn seed provided herein comprises at least 190 SSUs per acre. In an aspect, the yield of hybrid corn seed provided herein comprises at least 200 SSUs per acre.

In an aspect, the hybrid corn seed yield provided herein comprises between 80 SSUs per acre and 200 SSUs per acre. In an aspect, the hybrid corn seed yield provided herein comprises between 80 SSUs per acre and 190 SSUs per acre. In an aspect, the hybrid corn seed yield provided herein comprises between 80 SSUs per acre and 180 SSUs per acre. In an aspect, the hybrid corn seed yield provided herein comprises between 80 SSUs per acre and 170 SSUs per acre. In an aspect, the hybrid corn seed yield provided herein comprises between 80 SSUs per acre and 160 SSUs per acre. In an aspect, the hybrid corn seed yield provided herein comprises between 80 SSUs per acre and 150 SSUs per acre. In an aspect, the hybrid corn seed yield provided herein comprises between 80 SSUs per acre and 140 SSUs per acre. In an aspect, the hybrid corn seed yield provided herein comprises between 80 SSUs per acre and 130 SSUs per acre. In an aspect, the hybrid corn seed yield provided herein comprises between 80 SSUs per acre and 120 SSUs per acre. In an aspect, the hybrid corn seed yield provided herein comprises between 80 SSUs per acre and 110 SSUs per acre. In an aspect, the hybrid corn seed yield provided herein comprises between 80 SSUs per acre and 100 SSUs per acre. In an aspect, the hybrid corn seed yield provided herein comprises between 80 SSUs per acre and 90 SSUs per acre.

In an aspect, the hybrid corn seed yield provided herein comprises between 90 SSUs per acre and 200 SSUs per acre. In an aspect, the hybrid corn seed yield provided herein comprises between 90 SSUs per acre and 190 SSUs per acre. In an aspect, the hybrid corn seed yield provided herein comprises between 90 SSUs per acre and 180 SSUs per acre. In an aspect, the hybrid corn seed yield provided herein comprises between 90 SSUs per acre and 170 SSUs per acre. In an aspect, the hybrid corn seed yield provided herein comprises between 90 SSUs per acre and 160 SSUs per acre. In an aspect, the hybrid corn seed yield provided herein comprises between 90 SSUs per acre and 150 SSUs per acre. In an aspect, the hybrid corn seed yield provided herein comprises between 90 SSUs per acre and 140 SSUs per acre. In an aspect, the hybrid corn seed yield provided herein comprises between 90 SSUs per acre and 130 SSUs per acre. In an aspect, the hybrid corn seed yield provided herein comprises between 90 SSUs per acre and 120 SSUs per acre. In an aspect, the hybrid corn seed yield provided herein comprises between 90 SSUs per acre and 110 SSUs per acre. In an aspect, the hybrid corn seed yield provided herein comprises between 90 SSUs per acre and 100 SSUs per acre.

In an aspect, the hybrid corn seed yield provided herein comprises between 100 SSUs per acre and 200 SSUs per acre. In an aspect, the hybrid corn seed yield provided herein comprises between 100 SSUs per acre and 190 SSUs per acre. In an aspect, the hybrid corn seed yield provided herein comprises between 100 SSUs per acre and 180 SSUs per acre. In an aspect, the hybrid corn seed yield provided herein comprises between 100 SSUs per acre and 170 SSUs per acre. In an aspect, the hybrid corn seed yield provided herein comprises between 100 SSUs per acre and 160 SSUs per acre. In an aspect, the hybrid corn seed yield provided herein comprises between 100 SSUs per acre and 150 SSUs per acre. In an aspect, the hybrid corn seed yield provided herein comprises between 100 SSUs per acre and 140 SSUs per acre. In an aspect, the hybrid corn seed yield provided herein comprises between 100 SSUs per acre and 130 SSUs per acre. In an aspect, the hybrid corn seed yield provided herein comprises between 100 SSUs per acre and 120 SSUs per acre. In an aspect, the hybrid corn seed yield provided herein comprises between 100 SSUs per acre and 110 SSUs per acre.

In an aspect, the hybrid corn seed yield provided herein comprises between 110 SSUs per acre and 200 SSUs per acre. In an aspect, the hybrid corn seed yield provided herein comprises between 110 SSUs per acre and 190 SSUs per acre. In an aspect, the hybrid corn seed yield provided herein comprises between 110 SSUs per acre and 180 SSUs per acre. In an aspect, the hybrid corn seed yield provided herein comprises between 110 SSUs per acre and 170 SSUs per acre. In an aspect, the hybrid corn seed yield provided herein comprises between 110 SSUs per acre and 160 SSUs per acre. In an aspect, the hybrid corn seed yield provided herein comprises between 110 SSUs per acre and 150 SSUs per acre. In an aspect, the hybrid corn seed yield provided herein comprises between 110 SSUs per acre and 140 SSUs per acre. In an aspect, the hybrid corn seed yield provided herein comprises between 110 SSUs per acre and 130 SSUs per acre. In an aspect, the hybrid corn seed yield provided herein comprises between 110 SSUs per acre and 120 SSUs per acre.

In an aspect, the hybrid corn seed yield provided herein comprises between 120 SSUs per acre and 200 SSUs per acre. In an aspect, the hybrid corn seed yield provided herein comprises between 120 SSUs per acre and 190 SSUs per acre. In an aspect, the hybrid corn seed yield provided herein comprises between 120 SSUs per acre and 180 SSUs per acre. In an aspect, the hybrid corn seed yield provided herein comprises between 120 SSUs per acre and 170 SSUs per acre. In an aspect, the hybrid corn seed yield provided herein comprises between 120 SSUs per acre and 160 SSUs per acre. In an aspect, the hybrid corn seed yield provided herein comprises between 120 SSUs per acre and 150 SSUs per acre. In an aspect, the hybrid corn seed yield provided herein comprises between 120 SSUs per acre and 140 SSUs per acre. In an aspect, the hybrid corn seed yield provided herein comprises between 120 SSUs per acre and 130 SSUs per acre.

In an aspect, the hybrid corn seed yield provided herein comprises between 130 SSUs per acre and 200 SSUs per acre. In an aspect, the hybrid corn seed yield provided herein comprises between 130 SSUs per acre and 190 SSUs per acre. In an aspect, the hybrid corn seed yield provided herein comprises between 130 SSUs per acre and 180 SSUs per acre. In an aspect, the hybrid corn seed yield provided herein comprises between 130 SSUs per acre and 170 SSUs per acre. In an aspect, the hybrid corn seed yield provided herein comprises between 130 SSUs per acre and 160 SSUs per acre. In an aspect, the hybrid corn seed yield provided herein comprises between 130 SSUs per acre and 150 SSUs per acre. In an aspect, the hybrid corn seed yield provided herein comprises between 130 SSUs per acre and 140 SSUs per acre.

In an aspect, the hybrid corn seed yield provided herein comprises between 140 SSUs per acre and 200 SSUs per acre. In an aspect, the hybrid corn seed yield provided herein comprises between 140 SSUs per acre and 190 SSUs per acre. In an aspect, the hybrid corn seed yield provided herein comprises between 140 SSUs per acre and 180 SSUs per acre. In an aspect, the hybrid corn seed yield provided herein comprises between 140 SSUs per acre and 170 SSUs per acre. In an aspect, the hybrid corn seed yield provided herein comprises between 140 SSUs per acre and 160 SSUs per acre. In an aspect, the hybrid corn seed yield provided herein comprises between 140 SSUs per acre and 150 SSUs per acre.

In an aspect, the hybrid corn seed yield provided herein comprises between 150 SSUs per acre and 200 SSUs per acre. In an aspect, the hybrid corn seed yield provided herein comprises between 150 SSUs per acre and 190 SSUs per acre. In an aspect, the hybrid corn seed yield provided herein comprises between 150 SSUs per acre and 180 SSUs per acre. In an aspect, the hybrid corn seed yield provided herein comprises between 150 SSUs per acre and 170 SSUs per acre. In an aspect, the hybrid corn seed yield provided herein comprises between 150 SSUs per acre and 160 SSUs per acre.

In an aspect, the hybrid corn seed yield provided herein comprises between 160 SSUs per acre and 200 SSUs per acre. In an aspect, the hybrid corn seed yield provided herein comprises between 160 SSUs per acre and 190 SSUs per acre. In an aspect, the hybrid corn seed yield provided herein comprises between 160 SSUs per acre and 180 SSUs per acre. In an aspect, the hybrid corn seed yield provided herein comprises between 160 SSUs per acre and 170 SSUs per acre. In an aspect, the hybrid corn seed yield provided herein comprises between 170 SSUs per acre and 200 SSUs per acre. In an aspect, the hybrid corn seed yield provided herein comprises between 170 SSUs per acre and 190 SSUs per acre. In an aspect, the hybrid corn seed yield provided herein comprises between 170 SSUs per acre and 180 SSUs per acre. In an aspect, the hybrid corn seed yield provided herein comprises between 180 SSUs per acre and 200 SSUs per acre. In an aspect, the hybrid corn seed yield provided herein comprises between 180 SSUs per acre and 190 SSUs per acre.

In an aspect, the yield of hybrid corn seed provided herein comprises between 190 SSUs per acre and 200 SSUs per acre.

As used herein, "detasseled" corn refers to corn where the pollen-producing flowers, or tassels, have been removed. Detasseling is typically performed before the tassel can shed pollen. Detasseling can be accomplished via machine detasseling, manual detasseling, or a combination of both machine and manual detasseling. Detasseling often removes the uppermost leaves of the corn plant along with the developing tassel. Detasseled corn plants retain their female flowers, which eventually produce kernels on the ear. In an aspect, a corn plant provided herein is a detasseled corn plant.

In an aspect, the female corn plants provided herein have been detasseled. In another aspect, at least 50% of the female corn plants provided herein have been detasseled. In another aspect, at least 60% of the female corn plants provided herein have been detasseled. In another aspect, at least 70% of the female corn plants provided herein have been detasseled. In another aspect, at least 80% of the female corn plants provided herein have been detasseled. In another aspect, at least 90% of the female corn plants provided herein have been detasseled. In another aspect, at least 95% of the female corn plants provided herein have been detasseled. In another aspect, 99% of the female corn plants provided herein have been detasseled. In another aspect, 100% of the female corn plants provided herein have been detasseled.

As an alternative to detasseling, the female corn plants can have sterility through genetic crosses and inheritance and/or use of an inducible system. One system that can be employed to induce male sterility in female corn plants is the Roundup® hybridization system (RHS), wherein the male reproductive tissues or tassels are unable to produce pollen following treatment with glyphosate during an appropriate window of plant development. In one RHS system, corn plants (or female corn plants) in a seed production field have a Roundup® or glyphosate resistant 5-enolpyruvylshikimate-3-phosphate synthase (EPSPS) transgene, but due to the combination expression elements, the expression of the transgene in male reproductive tissues is low. As a result, when these corn plants (or female corn plants) are treated with glyphosate, their male reproductive structures or tassels do not develop to produce pollen. In a second generation RHS system (RHS2), the corn plants (or female corn plants) in a seed production field have a Roundup® or glyphosate resistant 5-enolpyruvylshikimate-3-phosphate synthase (EPSPS) transgene that further contains in its 3' untranslated region (UTR) a target site for an endogenous small interfering RNA (siRNA) expressed specifically in male tissues. Thus, expression of the transgene is suppressed in the male reproductive tissues to render those tissues susceptible to Roundup® or glyphosate treatment. Accordingly, corn plants (or female corn plants) containing this transgene can be made male sterile and unable to produce pollen by Roundup® or glyphosate treatment. According to some embodiments, corn plants (or female corn plants) comprise a RHS event, such as MON 87427 (see, e.g., U.S. Application Pub. No. 2011/0126310, the entire contents and disclosure of which are incorporated herein by reference) or MON 87429 (see, e.g., U.S. Provisional App. No. 62/625,537, the entire contents and disclosure of which are incorporated herein by reference). In addition to the RHS system, other chemical hybridizing agents (CHAs) known in the art could be used to make corn plants male sterile.

As an alternative to chemical treatment, corn plants (or female corn plants) can be made male sterile through genetic crosses and inheritance causing cytoplasmic male sterility. As used herein, the term "cytoplasmic male sterility" or "CMS" refers to a condition where a corn plant is partially or fully incapable of producing functional pollen. As known in the art, cytoplasmic male sterility is a maternally inherited trait that is commonly associated with unusual open reading frames within the mitochondrial genome which cause cytoplasmic dysfunction. In an aspect, a corn plant or female corn plant provided herein is a cytoplasmic male sterile corn plant.

The shorter plant heights of female corn plants in a production field as provided herein are more accessible for over-the-top treatment with a chemical hybridizing agent or glyphosate (or Roundup®) treatment with standard farming equipment without damaging the female corn plants. In an aspect, methods are provided for planting and treating shorter female corn plants in a seed production field as described herein with a chemical hybridizing agent or glyphosate (or Roundup®) to induce male sterility. In another aspect, shorter female corn plants in a seed production field as described herein further have cytoplasmic male sterility.

In an aspect, the female corn plants provided herein exhibit cytoplasmic male sterility. In another aspect, at least 60% of the female corn plants in a corn field provided herein exhibit cytoplasmic male sterility. In another aspect, at least 70% of the female corn plants in a corn field provided herein exhibit cytoplasmic male sterility. In another aspect, at least 80% of the female corn plants in a corn field provided herein exhibit cytoplasmic male sterility. In another aspect, at least 90% of the female corn plants in a corn field provided herein exhibit cytoplasmic male sterility. In another aspect, 100% of the female corn plants in a corn field provided herein exhibit cytoplasmic male sterility.

In an aspect, this disclosure provides a method of fertilizing at least one female inbred corn plant with pollen from at least one male inbred corn plant, where the at least one female inbred corn plant has an average height that is at least 2.5% lower than the height (or average height) of the at least one male inbred corn plant, and then harvesting the hybrid corn seeds produced by the at least one female inbred corn plant, where the yield and/or seed yield of harvested hybrid corn seeds is greater than the yield and/or seed yield that is obtained by fertilizing at least one control female inbred corn plant with pollen from at least one male control inbred corn plant where the female and male control plants have the same or similar average height or do not differ in average height by more than 1%. In an aspect, this disclosure provides a method of fertilizing at least one female inbred corn plant with pollen from at least one male inbred corn plant, where the at least one female inbred corn plant has an average height that is at least 5% lower than the height (or average height) of the at least one male inbred corn plant, and then harvesting the hybrid corn seeds produced by the at least one female inbred corn plant, where the yield and/or seed yield of harvested hybrid corn seeds is greater than the yield and/or seed yield that is obtained by fertilizing at least one control female inbred corn plant with pollen from at least one male control inbred corn plant where the female and male control plants have the same or similar average height or do not differ in average height by more than 1% or 2.5%. In an aspect, this disclosure provides a method of fertilizing at least one female inbred corn plant with pollen from at least one male inbred corn plant, where the at least one female inbred corn plant has an average height that is at least 10% lower than the height (or average height) of the at least one male inbred corn plant, and then harvesting the hybrid corn seeds produced by the at least one female inbred corn plant, where the yield and/or seed yield of harvested hybrid corn seeds is greater than the yield and/or seed yield that is obtained by fertilizing at least one control female inbred corn plant with pollen from at least one male control inbred corn plant where the female and male control plants have the same or similar average height or do not differ in average height by more than 1%, 2.5% or 5%. In another aspect, this disclosure provides a method of fertilizing a plurality of female inbred corn plants with pollen from at least one male inbred corn plant, where the female inbred corn plants have an average height that is at least 10% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants have the same or similar average height or do not differ in average height by more than 1%, 2.5% or 5%. In an aspect, this disclosure provides a method of fertilizing a plurality of female inbred corn plants with pollen from at least one male inbred corn plant, where the female inbred corn plants have an average height that is at least 15% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants have the same or similar average height or do not differ in average height by more than 1%, 2.5% or 5%. In an aspect, this disclosure provides a method of fertilizing a plurality of female inbred corn plants with pollen from at least one male inbred corn plant, where the female inbred corn plants have an average height that is at least 20% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants have the same or similar average height or do not differ in average height by more than 1%, 2.5% or 5%. In an aspect, this disclosure provides a method of fertilizing a plurality of female inbred corn plants with pollen from at least one male inbred corn plant, where the female inbred corn plants have an average height that is at least 25% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants have the same or similar average height or do not differ in average height by more than 1%, 2.5% or 5%. In an aspect, this disclosure provides a method of fertilizing a plurality of female inbred corn plants with pollen from at least one male inbred corn plant, where the female inbred corn plants have an average height that is at least 30% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants have the same or similar average height or do not differ in average height by more than 1%, 2.5% or 5%.

In another aspect, this disclosure provides a method of fertilizing a plurality of female inbred corn plants with pollen from at least one male inbred corn plant, where the female inbred corn plants have an average height that is at least 10% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants do not differ in average height by more than 7.5%. In an aspect, this disclosure provides a method of fertilizing a plurality of female inbred corn plants with pollen from at least one male inbred corn plant, where the female inbred corn plants have an average height that is at least 15% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants do not differ in average height by more than 7.5%. In an aspect, this disclosure provides a method of fertilizing a plurality of female inbred corn plants with pollen from at least one male inbred corn plant, where the female inbred corn plants have an average height that is at least 20% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants do not differ in average height by more than 7.5%. In an aspect, this disclosure provides a method of fertilizing a plurality of female inbred corn plants with pollen from at least one male inbred corn plant, where the female inbred corn plants have an average height that is at least 25% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants do not differ in average height by more than 7.5%. In an aspect, this disclosure provides a method of fertilizing a plurality of female inbred corn plants with pollen from at least one male inbred corn plant, where the female inbred corn plants have an average height that is at least 30% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants do not differ in average height by more than 7.5%.

In an aspect, this disclosure provides a method of fertilizing at least one female inbred corn plant with pollen from at least one male inbred corn plant, where the at least one female inbred corn plant has an average height that is at least 15% lower than the height (or average height) of the at least one male inbred corn plant, and then harvesting the hybrid corn seeds produced by the at least one female inbred corn plant, where the yield and/or seed yield of harvested hybrid corn seeds is greater than the yield and/or seed yield that is obtained by fertilizing at least one control female inbred corn plant with pollen from at least one male control inbred corn plant where the female and male control plants do not differ in average height by more than 10%. In another aspect, this disclosure provides a method of fertilizing a plurality of female inbred corn plants with pollen from at least one male inbred corn plant, where the female inbred corn plants have an average height that is at least 15% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants do not differ in average height by more than 10%. In an aspect, this disclosure provides a method of fertilizing a plurality of female inbred corn plants with pollen from at least one male inbred corn plant, where the female inbred corn plants have an average height that is at least 20% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants do not differ in average height by more than 10%. In an aspect, this disclosure provides a method of fertilizing a plurality of female inbred corn plants with pollen from at least one male inbred corn plant, where the female inbred corn plants have an average height that is at least 25% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants do not differ in average height by more than 10%. In an aspect, this disclosure provides a method of fertilizing a plurality of female inbred corn plants with pollen from at least one male inbred corn plant, where the female inbred corn plants have an average height that is at least 30% lower than the height (or average height) of the at least one male inbred corn plant, and then harvesting the hybrid corn seeds produced by one or more of the female inbred corn plants, where the yield and/or seed yield of harvested hybrid corn seeds is greater than the yield and/or seed yield that is obtained by fertilizing a plurality of control female inbred corn plants with pollen from at least one male control inbred corn plant where the female and male control plants do not differ in average height by more than 10%.

In an aspect, this disclosure provides a method of fertilizing at least one female inbred corn plant with pollen from at least one male inbred corn plant, where the female-to-male plant height ratio is 0.98:1 or less, and then harvesting the hybrid corn seeds produced by the at least one female inbred corn plant, where the yield, seed yield or SSUs of harvested hybrid corn seeds is greater than the yield, seed yield or SSUs that is obtained by fertilizing at least one control female inbred corn plant with pollen from at least one male control inbred corn plant, where the female-to-male control plant height ratio is about 1:1. In an aspect, this disclosure provides a method of fertilizing at least one female inbred corn plant with pollen from at least one male inbred corn plant, where the female-to-male plant height ratio is 0.97:1 or less, and then harvesting the hybrid corn seeds produced by the at least one female inbred corn plant, where the yield, seed yield or SSUs of harvested hybrid corn seeds is greater than the yield, seed yield or SSUs that is obtained by fertilizing at least one control female inbred corn plant with pollen from at least one male control inbred corn plant, where the female-to-male control plant height ratio is about 1:1. In an aspect, this disclosure provides a method of fertilizing at least one female inbred corn plant with pollen from at least one male inbred corn plant, where the female-to-male plant height ratio is 0.96:1 or less, and then harvesting the hybrid corn seeds produced by the at least one female inbred corn plant, where the yield, seed yield or SSUs of harvested hybrid corn seeds is greater than the yield, seed yield or SSUs that is obtained by fertilizing at least one control female inbred corn plant with pollen from at least one male control inbred corn plant, where the female-to-male control plant height ratio is about 1:1. In another aspect, this disclosure provides a method of fertilizing a plurality of female inbred corn plants with pollen from at least one male inbred corn plant, where the female-to-male plant height ratio is 0.95:1 or less, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1. In an aspect, this disclosure provides a method of fertilizing at least one female inbred corn plant with pollen from at least one male inbred corn plant, where the female-to-male plant height ratio is 0.9:1 or less, and then harvesting the hybrid corn seeds produced by the at least one female inbred corn plant, where the yield, seed yield or SSUs of harvested hybrid corn seeds is greater than the yield or SSUs that is obtained by fertilizing at least one control female inbred corn plant with pollen from at least one male control inbred corn plant, where the female-to-male control plant height ratio is about 1:1 or between 0.95:1 and 1:1. In another aspect, this disclosure provides a method of fertilizing a plurality of female inbred corn plants with pollen from at least one male inbred corn plant, where the female-to-male plant height ratio is 0.9:1 or less, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.95:1 and 1:1. In another aspect, this disclosure provides a method of fertilizing a plurality of female inbred corn plants with pollen from at least one male inbred corn plant, where the female-to-male plant height ratio is 0.85:1 or less, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.95:1 and 1:1. In an aspect, this disclosure provides a method of fertilizing a plurality of female inbred corn plants with pollen from at least one male inbred corn plant, where the female-to-male plant height ratio is 0.8:1 or less, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.95:1 and 1:1. In an aspect, this disclosure provides a method of fertilizing a plurality of female inbred corn plants with pollen from at least one male inbred corn plant, where the female-to-male plant height ratio is 0.75:1 or less, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.95:1 and 1:1. In an aspect, this disclosure provides a method of fertilizing a plurality of female inbred corn plants with pollen from at least one male inbred corn plant, where the female-to-male plant height ratio is 0.7:1 or less, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.95:1 and 1:1. In an aspect, this disclosure provides a method of fertilizing a plurality of female inbred corn plants with pollen from at least one male inbred corn plant, where the female-to-male plant height ratio is 0.6:1 or less, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.95:1 and 1:1.

In an aspect, this disclosure provides a method of fertilizing a plurality of female inbred corn plants with pollen from at least one male inbred corn plant, where the female-to-male plant height ratio is between 0.6:1 and 0.95:1, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.95:1 and 1:1. In an aspect, this disclosure provides a method of fertilizing a plurality of female inbred corn plants with pollen from at least one male inbred corn plant, where the female-to-male plant height ratio is between 0.7:1 and 0.95:1, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.95:1 and 1:1. In an aspect, this disclosure provides a method of fertilizing a plurality of female inbred corn plants with pollen from at least one male inbred corn plant, where the female-to-male plant height ratio is between 0.8:1 and 0.95:1, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.95:1 and 1:1.

In an aspect, this disclosure provides a method of fertilizing a plurality of female inbred corn plants with pollen from at least one male inbred corn plant, where the female-to-male plant height ratio is 0.85:1 or less, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.9:1 and 1:1. In an aspect, this disclosure provides a method of fertilizing a plurality of female inbred corn plants with pollen from at least one male inbred corn plant, where the female-to-male plant height ratio is 0.8:1 or less, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.9:1 and 1:1. In an aspect, this disclosure provides a method of fertilizing a plurality of female inbred corn plants with pollen from at least one male inbred corn plant, where the female-to-male plant height ratio is 0.75:1 or less, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.9:1 and 1:1. In an aspect, this disclosure provides a method of fertilizing a plurality of female inbred corn plants with pollen from at least one male inbred corn plant, where the female-to-male plant height ratio is 0.7:1 or less, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.9:1 and 1:1. In an aspect, this disclosure provides a method of fertilizing a plurality of female inbred corn plants with pollen from at least one male inbred corn plant, where the female-to-male plant height ratio is 0.6:1 or less, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.9:1 and 1:1. In an aspect, this disclosure provides a method of fertilizing a plurality of female inbred corn plants with pollen from at least one male inbred corn plant, where the female-to-male plant height ratio is between 0.6:1 and 0.9:1, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the female-to-male control plant height ratio is about 1:1 or between 0.9:1 and 1:1.

In an aspect, this disclosure provides a method of fertilizing at least one female inbred corn plant with pollen from at least one male inbred corn plant, where the at least one female-inbred corn plant has a height (or average height) that is at least 2.0 meters shorter, at least 1.5 meters shorter, at least 1.4 meters shorter, at least 1.3 meters shorter, at least 1.2 meters shorter, at least 1.1 meters shorter, at least 1.0 meters shorter, at least 0.9 meters shorter, at least 0.8 meters shorter, at least 0.7 meters shorter, at least 0.6 meters shorter, at least 0.5 meters shorter, at least 0.4 meters shorter, at least 0.3 meters shorter than the height (or average height) of the at least one male inbred corn plant, and then harvesting the hybrid corn seeds produced by the at least one female inbred corn plant, where the yield, seed yield or SSUs of harvested hybrid corn seeds is greater than the yield, seed yield or SSUs that is obtained by fertilizing at least one control female inbred corn plant with pollen from at least one control male inbred corn plant, where the female control plant height is no more than 0.25 meters shorter than the height of the at least one male control plant. In an aspect, this disclosure provides a method of fertilizing a plurality of female inbred corn plants with pollen from at least one male inbred corn plant, where the average female-inbred corn plant height is at least 1.5 meters shorter, at least 1.4 meters shorter, at least 1.3 meters shorter, at least 1.2 meters shorter, at least 1.1 meters shorter, at least 1.0 meters shorter, at least 0.9 meters shorter, at least 0.8 meters shorter, at least 0.7 meters shorter, at least 0.6 meters shorter, at least 0.5 meters shorter, at least 0.4 meters shorter, at least 0.3 meters shorter, or at least 0.2 meters shorter than the height (or average height) of the at least one male inbred corn plant, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one control male inbred corn plant, where the average female control plant height is about the same as, or is no more than 0.2 meters shorter than, the height of the at least one male control plant. In an aspect, this disclosure provides a method of fertilizing a plurality of female inbred corn plants with pollen from at least one male inbred corn plant, where the average female-inbred corn plant height is at least 1.5 meters shorter, at least 1.4 meters shorter, at least 1.3 meters shorter, at least 1.2 meters shorter, at least 1.1 meters shorter, at least 1.0 meters shorter, at least 0.9 meters shorter, at least 0.8 meters shorter, at least 0.7 meters shorter, at least 0.6 meters shorter, at least 0.5 meters shorter, at least 0.4 meters shorter, at least 0.3 meters shorter, at least 0.2 meters shorter, or at least 0.1 meters shorter than the height (or average height) of the at least one male inbred corn plant, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one control male inbred corn plant, where the average female control plant height is about the same as, or is no more than 0.15 meters shorter than, the height of the at least one male control plant. In an aspect, this disclosure provides a method of fertilizing a plurality of female inbred corn plants with pollen from at least one male inbred corn plant, where the average female-inbred corn plant height is at least 1.5 meters shorter, at least 1.4 meters shorter, at least 1.3 meters shorter, at least 1.2 meters shorter, at least 1.1 meters shorter, at least 1.0 meters shorter, at least 0.9 meters shorter, at least 0.8 meters shorter, at least 0.7 meters shorter, at least 0.6 meters shorter, at least 0.5 meters shorter, at least 0.4 meters shorter, at least 0.3 meters shorter, at least 0.2 meters shorter, or at least 0.1 meters shorter than the height (or average height) of the at least one male inbred corn plant, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one control male inbred corn plant, where the average female control plant height is about the same as, or is no more than 0.1 meters shorter than the height of the at least one male control plant.

In an aspect, this disclosure provides a method of fertilizing a plurality of female inbred corn plants with pollen from at least one male inbred corn plant, where the average female inbred corn plant height is between 0.1 and 1.0 meters shorter, between 0.2 and 1.0 meters shorter, or between 0.2 and 0.5 meters shorter than the height (or average height) of the at least one male inbred corn plant, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the average female control plant height is the same or similar as, or is no more than 0.25 meters, 0.2 meters, 0.15 meters, or 0.1 meters shorter than, the height (or average height) of the at least one male control plant. In an aspect, this disclosure provides a method of fertilizing a plurality of female inbred corn plants with pollen from at least one male inbred corn plant, where the average female-inbred corn plant height is between 0.5 and 1.0 meters shorter than the height (or average height) of the at least one male inbred corn plant, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the average female control plant height is the same or similar as, or is no more than 0.25 meters, 0.2 meters, 0.15 meters, or 0.1 meters shorter than, the height (or average height) of the at least one male control plant. In another aspect, this disclosure provides a method of fertilizing a plurality of female inbred corn plants with pollen from at least one male inbred corn plant, where the average female-inbred corn plant height is between 1.0 and 1.5 meters shorter than the height (or average height) of the male inbred corn plant, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the average female control plant height is the same or similar as, or is no more than 0.25 meters, 0.2 meters, 0.15 meters, or 0.1 meters shorter than, the height (or average height) of the at least one male control plant. In another aspect, this disclosure provides a method of fertilizing a plurality of female inbred corn plants with pollen from at least one male inbred corn plant, where the average female-inbred corn plant height is between 1.5 and 2.0 meters shorter than the height (or average height) of the at least one male inbred corn plant, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the average female control plant height is the same or similar as, or is no more than 0.25 meters, 0.2 meters, 0.15 meters, or 0.1 meters shorter than, the height (or average height) of the male control plant. In another aspect, this disclosure provides a method of fertilizing a plurality of female inbred corn plants with pollen from at least one male inbred corn plant, where the average female-inbred corn plant height is between 0.5 and 1.5 meters shorter than the height (or average height) of the at least one male inbred corn plant, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the average female control plant height is the same or similar as, or is no more than 0.25 meters, 0.2 meters, 0.15 meters, or 0.1 meters shorter than, the height (or average height) of the at least one male control plant. In another aspect, this disclosure provides a method of fertilizing a plurality of female inbred corn plants with pollen from at least one male inbred corn plant, where the average female-inbred corn plant height is between 1.0 and 2.0 meters shorter than the height (or average height) of the at least one male inbred corn plant, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the average female control plant height is the same or similar as, or is no more than 0.25 meters, 0.2 meters, 0.15 meters, or 0.1 meters shorter than, the height (or average height) of the at least one male control plant. In another aspect, this disclosure provides a method of fertilizing a plurality of female inbred corn plants with pollen from at least one male inbred corn plant, where the average female-inbred corn plant height is between 0.5 and 2.0 meters shorter than the height (or average height) of the at least one male inbred corn plant, and then harvesting the hybrid corn seeds produced by one or more of the female inbred corn plants, where the yield, seed yield or SSUs of harvested hybrid corn seeds is greater than the yield, seed yield or SSUs that is obtained by fertilizing a plurality of control female inbred corn plants with pollen from at least one male control inbred corn plant, where the average female control plant height is the same or similar as, or is no more than 0.25 meters, 0.2 meters, 0.15 meters, or 0.1 meters shorter than, the height (or average height) of the at least one male control plant.

In an aspect, the yield, seed yield or SSUs of hybrid corn seed is increased by at least 1.0%. In an aspect, the yield, seed yield or SSUs of hybrid corn seed is increased by at least 1.5%. In an aspect, the yield, seed yield or SSUs of hybrid corn seed is increased by at least 2.0%. In an aspect, the yield, seed yield or SSUs of hybrid corn seed is increased by at least 2.5%. In an aspect, the yield, seed yield or SSUs of hybrid corn seed is increased by at least 3.0%. In another aspect, the yield, seed yield or SSUs of hybrid corn seed is increased by at least 3.5%. In another aspect, the yield, seed yield or SSUs of hybrid corn seed is increased by at least 4.0%. In another aspect, the yield, seed yield or SSUs of hybrid corn seed is increased by at least 4.5%. In another aspect, the yield, seed yield or SSUs of hybrid corn seed is increased by at least 5.0%. In another aspect, the yield, seed yield or SSUs of hybrid corn seed is increased by at least 5.5%. In another aspect, the yield, seed yield or SSUs of hybrid corn seed is increased by at least 6.0%. In another aspect, the yield, seed yield or SSUs of hybrid corn seed is increased by at least 6.5%. In another aspect, the yield, seed yield or SSUs of hybrid corn seed is increased by at least 7.0%. In another aspect, the yield, seed yield or SSUs of hybrid corn seed is increased by at least 7.5%. In another aspect, the yield, seed yield or SSUs of hybrid corn seed is increased by at least 8.0%. In another aspect, the yield, seed yield or SSUs of hybrid corn seed is increased by at least 8.5%. In another aspect, the yield, seed yield or SSUs of hybrid corn seed is increased by at least 9.0%. In another aspect, the yield, seed yield or SSUs of hybrid corn seed is increased by at least 9.5%. In another aspect, the yield, seed yield or SSUs of hybrid corn seed is increased by at least 10%. In another aspect, the yield, seed yield of hybrid corn seed is increased by at least 11%. In another aspect, the yield, seed yield or SSUs of hybrid corn seed is increased by at least 12%. In another aspect, the yield, seed yield or SSUs of hybrid corn seed is increased by at least 13%. In another aspect, the yield, seed yield or SSUs of hybrid corn seed is increased by at least 14%. In another aspect, the yield, seed yield or SSUs of hybrid corn seed is increased by at least 15%. In another aspect, the yield, seed yield or SSUs of hybrid corn seed is increased by at least 16%. In another aspect, the yield, seed yield or SSUs of hybrid corn seed is increased by at least 17%. In another aspect, the yield, seed yield or SSUs of hybrid corn seed is increased by at least 18%. In another aspect, the yield, seed yield or SSUs of hybrid corn seed is increased by at least 19%. In another aspect, the yield, seed yield or SSUs of hybrid corn seed is increased by at least 20%.

In another aspect, the yield, seed yield or SSUs of hybrid corn seed is increased by between 1% and 20%. In another aspect, the yield, seed yield or SSUs of hybrid corn seed is increased by between 1% and 15%. In another aspect, the yield, seed yield or SSUs of hybrid corn seed is increased by between 1% and 10%. In another aspect, the yield, seed yield or SSUs of hybrid corn seed is increased by between 1% and 5%. In another aspect, the yield, seed yield or SSUs of hybrid corn seed is increased by between 3% and 6%. In another aspect, the yield, seed yield or SSUs of hybrid corn seed is increased by between 6% and 9%. In another aspect, the yield, seed yield or SSUs of hybrid corn seed is increased by between 9% and 12%. In another aspect, the yield, seed yield or SSUs of hybrid corn seed is increased by between 12% and 15%. In another aspect, the yield, seed yield or SSUs of hybrid corn seed is increased by between 15% and 18%. In another aspect, the yield, seed yield or SSUs of hybrid corn seed is increased by between 18% and 20%. In another aspect, the yield, seed yield or SSUs of hybrid corn seed is increased by between 3% and 12%. In another aspect, the yield, seed yield or SSUs of hybrid corn seed is increased by between 12% and 20%. In another aspect, the yield, seed yield or SSUs of hybrid corn seed is increased by between 3% and 20%. Any other range of increased yield, seed yield or SSUs of hybrid corn seed above 1% is contemplated herein.

In an aspect, this disclosure provides a method of crossing at least one male inbred corn plant with at least one female inbred corn plant to produce hybrid corn seeds, where the at least one female inbred corn plant has an average height that is at least 2.5% lower than the height (or average height) of the at least one male inbred corn plant, and then harvesting the hybrid corn seeds produced by the at least one female inbred corn plant. In an aspect, this disclosure provides a method of crossing at least one male inbred corn plant with at least one female inbred corn plant to produce hybrid corn seeds, where the at least one female inbred corn plant has an average height that is at least 5% lower than the height (or average height) of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has an average height that is at least 7.5% lower than the height (or average height) of the at least one male inbred corn plant, and then harvesting the hybrid corn seeds produced by the at least one female inbred corn plant. In an aspect, this disclosure provides a method of crossing at least one male inbred corn plant with at least one female inbred corn plant to produce hybrid corn seeds, where the at least one female inbred corn plants has an average height that is at least 10% lower than the height (or average height) of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has an average height that is at least 12.5% lower than the height (or average height) of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has an average height that is at least 15% lower than the height (or average height) of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has an average height that is at least 17.5% lower than the height (or average height) of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has an average height that is at least 20% lower than the height (or average height) of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has an average height that is at least 25% lower than the height (or average height) of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant have an average height that is at least 30% lower than the height (or average height) of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant have an average height that is at least 35% lower than the height (or average height) of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has an average height that is at least 40% lower than the height (or average height) of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has an average height that is at least 45% lower than the height (or average height) of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has an average height that is at least 50% lower than the height (or average height) of the at least one male inbred corn plant, and then harvesting the hybrid corn seeds produced by one or more of the female inbred corn plants.

In an aspect, this disclosure provides a method of crossing at least one male inbred corn plant with at least one female inbred corn plant to produce hybrid corn seeds, where the female-to-male plant height ratio is 0.95:1 or less, and then harvesting the hybrid corn seeds produced by the at least one female inbred corn plant. In an aspect, this disclosure provides a method of crossing at least one male inbred corn plant with a plurality of female inbred corn plants to produce hybrid corn seeds, where the female-to-male plant height ratio is 0.95:1 or less, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the female-to-male plant height ratio is 0.9:1 or less, and then harvesting the hybrid corn seeds produced by the at least one female inbred corn plant. In an aspect, this disclosure provides a method of crossing at least one male inbred corn plant with a plurality of female inbred corn plants to produce hybrid corn seeds, where the female-to-male plant height ratio is 0.9:1 or less, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the female-to-male plant height ratio is 0.85:1 or less, and then harvesting the hybrid corn seeds produced by the at least one female inbred corn plant. In an aspect, this disclosure provides a method of crossing at least one male inbred corn plant with a plurality of female inbred corn plants to produce hybrid corn seeds, where the female-to-male plant height ratio is 0.85:1 or less, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the female-to-male plant height ratio is 0.8:1 or less, and then harvesting the hybrid corn seeds produced by the at least one female inbred corn plant. In an aspect, this disclosure provides a method of crossing at least one male inbred corn plant with a plurality of female inbred corn plants to produce hybrid corn seeds, where the female-to-male plant height ratio is 0.8:1 or less, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the female-to-male plant height ratio is 0.75:1 or less, and then harvesting the hybrid corn seeds produced by the at least one female inbred corn plant. In an aspect, this disclosure provides a method of crossing at least one male inbred corn plant with a plurality of female inbred corn plants to produce hybrid corn seeds, where the female-to-male plant height ratio is 0.75:1 or less, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the female-to-male plant height ratio is 0.7:1 or less, and then harvesting the hybrid corn seeds produced by the at least one female inbred corn plant. In an aspect, this disclosure provides a method of crossing at least one male inbred corn plant with a plurality of female inbred corn plants to produce hybrid corn seeds, where the female-to-male plant height ratio is 0.7:1 or less, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the female-to-male plant height ratio is 0.65:1 or less, and then harvesting the hybrid corn seeds produced by the at least one female inbred corn plant. In an aspect, this disclosure provides a method of crossing at least one male inbred corn plant with a plurality of female inbred corn plants to produce hybrid corn seeds, where the female-to-male plant height ratio is 0.65:1 or less, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the female-to-male plant height ratio is 0.6:1 or less, and then harvesting the hybrid corn seeds produced by the at least one female inbred corn plant. In an aspect, this disclosure provides a method of crossing at least one male inbred corn plant with a plurality of female inbred corn plants to produce hybrid corn seeds, where the female-to-male plant height ratio is 0.6:1 or less, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the female-to-male plant height ratio is 0.55:1 or less, and then harvesting the hybrid corn seeds produced by the at least one female inbred corn plant. In an aspect, this disclosure provides a method of crossing at least one male inbred corn plant with a plurality of female inbred corn plants to produce hybrid corn seeds, where the female-to-male plant height ratio is 0.55:1 or less, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the female-to-male plant height ratio is 0.5:1 or less, and then harvesting the hybrid corn seeds produced by the at least one female inbred corn plant. In an aspect, this disclosure provides a method of crossing at least one male inbred corn plant with a plurality of female inbred corn plants to produce hybrid corn seeds, where the female-to-male plant height ratio is 0.5:1 or less, and then harvesting the hybrid corn seeds produced by one or more of the female inbred corn plants.

In an aspect, this disclosure provides a method of crossing at least one male inbred corn plant with at least one female inbred corn plant to produce hybrid corn seeds, where the at least one female inbred corn plant has a height that is at least 0.1 meters shorter or at least 0.2 meters shorter than the height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds, where the female inbred corn plants have an average height that is at least 0.1 meters shorter or at least 0.2 meters shorter than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has a height that is at least 0.3 meters shorter than the height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds, where the female inbred corn plants have an average height that is at least 0.3 meters shorter than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has a height that is at least 0.4 meters shorter than the height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds, where the female inbred corn plants have an average height that is at least 0.4 meters shorter than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has a height that is at least 0.5 meters shorter than the height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds, where the female inbred corn plants have an average height that is at least 0.5 meters shorter than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has a height that is at least 1.0 meters shorter than the height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds, where the female inbred corn plants have an average height that is at least 1.0 meters shorter than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has a height that is at least 1.5 meters shorter than the height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds, where the female inbred corn plants have an average height that is at least 1.5 meters shorter than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds, where the at least one female inbred corn plant has a height that is at least 2.0 meters shorter than the height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds, where the female inbred corn plants have an average height that is at least 2.0 meters shorter than the height of the at least one male inbred corn plant, and then harvesting the hybrid corn seeds produced by one or more of the female inbred corn plants.

In an aspect, this disclosure provides a method of planting at least one male inbred corn plant in proximity to a plurality of female inbred corn plants to produce hybrid corn seeds, where the female inbred corn plants have an average height that is between 0.1 and 0.5 meters or between 0.2 and 0.5 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female inbred corn plants have an average height that is between 0.5 and 1.0 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female inbred corn plants have an average height that is between 0.5 and 1.5 meters shorter than the height of the at least one male inbred corn plant, and then harvesting the hybrid corn seeds produced by one or more of the female inbred corn plants. In another aspect, this disclosure provides a method of crossing at least one male inbred corn plant with a plurality of female inbred corn plants to produce hybrid corn seeds, where the female inbred corn plants have an average height that is between 1.0 and 1.5 meters shorter than the height of the at least one male inbred corn plant, and then harvesting the hybrid corn seeds produced by one or more of the female inbred corn plants. In another aspect, this disclosure provides a method of crossing at least one male inbred corn plant with a plurality of female inbred corn plants to produce hybrid corn seeds, where the female inbred corn plants have an average height that is between 1.5 and 2.0 meters shorter than the height of the at least one male inbred corn plant, and then harvesting the hybrid corn seeds produced by one or more of the female inbred corn plants. In another aspect, this disclosure provides a method of crossing at least one male inbred corn plant with a plurality of female inbred corn plants to produce hybrid corn seeds, where the female inbred corn plants have an average height that is between 0.5 and 2.0 meters shorter than the height of the at least one male inbred corn plant, and then harvesting the hybrid corn seeds produced by one or more of the female inbred corn plants.

In an aspect, this disclosure provides a method of planting at least one male inbred corn plant in proximity to at least one female inbred corn plant to produce hybrid corn seeds, where the at least one female inbred corn plant has an average height that is at least 2.5% lower than the height of the at least one male inbred corn plant, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female inbred corn plants have an average height that is at least 2.5% lower than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has an average height that is at least 5% lower than the height of the at least one male inbred corn plant, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female inbred corn plants have an average height that is at least 5% lower than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has an average height that is at least 10% lower than the height of the at least one male inbred corn plant, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female inbred corn plants have an average height that is at least 10% lower than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has an average height that is at least 12.5% lower than the height of the at least one male inbred corn plant, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female inbred corn plants have an average height that is at least 12.5% lower than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has an average height that is at least 15% lower than the height of the at least one male inbred corn plant, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female inbred corn plants have an average height that is at least 15% lower than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has an average height that is at least 17.5% lower than the height of the at least one male inbred corn plant, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female inbred corn plants have an average height that is at least 17.5% lower than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has an average height that is at least 20% lower than the height of the at least one male inbred corn plant, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female inbred corn plants have an average height that is at least 20% lower than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has an average height that is at least 25% lower than the height of the at least one male inbred corn plant, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female inbred corn plants have an average height that is at least 25% lower than the height of the at least one male inbred corn plant, and then harvesting the hybrid corn seeds produced by one or more of the female inbred corn plants.

In an aspect, this disclosure provides a method of planting at least one male inbred corn plant in proximity to at least one female inbred corn plant to produce hybrid corn seeds, where the at least one female inbred corn plant has an average height that is at least 30% lower than the height of the at least one male inbred corn plant, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female inbred corn plants have an average height that is at least 30% lower than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has an average height that is at least 35% lower than the height of the at least one male inbred corn plant, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female inbred corn plants have an average height that is at least 35% lower than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has an average height that is at least 40% lower than the height of the at least one male inbred corn plant, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female inbred corn plants have an average height that is at least 40% lower than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has an average height that is at least 45% lower than the height of the at least one male inbred corn plant, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female inbred corn plants have an average height that is at least 45% lower than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has an average height that is at least 50% lower than the height of the at least one male inbred corn plant, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female inbred corn plants have an average height that is at least 50% lower than the height of the at least one male inbred corn plant, and then harvesting the hybrid corn seeds produced by one or more of the female inbred corn plants.

In an aspect, this disclosure provides a method of planting at least one male inbred corn plant in proximity to at least one female inbred corn plant to produce hybrid corn seeds, where the female-to-male plant height ratio is 0.98:1 or less, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female-to-male plant height ratio is 0.98:1 or less, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the female-to-male plant height ratio is 0.95:1 or less, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female-to-male plant height ratio is 0.95:1 or less, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the female-to-male plant height ratio is 0.9:1 or less, and then harvesting the hybrid corn seeds produced by the at least one female inbred corn plant. In another aspect, this disclosure provides a method of planting at least one male inbred corn plant in proximity to a plurality of female inbred corn plants to produce hybrid corn seeds, where the female-to-male plant height ratio is 0.9:1 or less, and then harvesting the hybrid corn seeds produced by one or more of the female inbred corn plants. In another aspect, this disclosure provides a method of planting at least one male inbred corn plant in proximity to a plurality of female inbred corn plants to produce hybrid corn seeds, where the female-to-male plant height ratio is 0.85:1 or less, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female-to-male plant height ratio is 0.8:1 or less, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female-to-male plant height ratio is 0.75:1 or less, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female-to-male plant height ratio is 0.7:1 or less, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female-to-male plant height ratio is 0.65:1 or less, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female-to-male plant height ratio is 0.6:1 or less, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female-to-male plant height ratio is 0.55:1 or less, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female-to-male plant height ratio is 0.5:1 or less, and then harvesting the hybrid corn seeds produced by one or more of the female inbred corn plants.

In an aspect, this disclosure provides a method of planting at least one male inbred corn plant in proximity to at least one female inbred corn plant to produce hybrid corn seeds, where the at least one female inbred corn plant has a height that is at least 0.1 meters or at least 0.2 meters shorter than the height of the at least one male inbred corn plant, and then harvesting the hybrid corn seeds produced by the at least one female inbred corn plant. In an aspect, this disclosure provides a method of planting at least one male inbred corn plant in proximity to a plurality of female inbred corn plants to produce hybrid corn seeds, where the female inbred corn plants have an average height that is at least 0.1 meters or at least 0.2 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has a height that is at least 0.3 meters shorter than the height of the at least one male inbred corn plant, and then harvesting the hybrid corn seeds produced by the at least one female inbred corn plant. In an aspect, this disclosure provides a method of planting at least one male inbred corn plant in proximity to a plurality of female inbred corn plants to produce hybrid corn seeds, where the female inbred corn plants have an average height that is at least 0.3 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has a height that is at least 0.4 meters shorter than the height of the at least one male inbred corn plant, and then harvesting the hybrid corn seeds produced by the at least one female inbred corn plant. In an aspect, this disclosure provides a method of planting at least one male inbred corn plant in proximity to a plurality of female inbred corn plants to produce hybrid corn seeds, where the female inbred corn plants have an average height that is at least 0.4 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to at least one female inbred corn plant to produce hybrid corn seeds, where the at least one female inbred corn plant has a height that is at least 0.5 meters shorter than the height of the at least one male inbred corn plant, and then harvesting the hybrid corn seeds produced by the at least one female inbred corn plant. In an aspect, this disclosure provides a method of planting at least one male inbred corn plant in proximity to a plurality of female inbred corn plants to produce hybrid corn seeds, where the female inbred corn plants have an average height that is at least 0.5 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female inbred corn plants have an average height that is at least 1.0 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female inbred corn plants have an average height that is at least 1.5 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female inbred corn plants have an average height that is at least 2.0 meters shorter than the height of the at least one male inbred corn plant, and then harvesting the hybrid corn seeds produced by one or more of the female inbred corn plants.

In an aspect, this disclosure provides a method of planting at least one male inbred corn plant in proximity to a plurality of female inbred corn plants to produce hybrid corn seeds, where the female inbred corn plants have an average height that is between 0.1 and 0.5 meters or between 0.2 and 0.5 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female inbred corn plants have an average height that is between 0.5 and 1.0 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female inbred corn plants have an average height that is between 0.5 and 1.5 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female inbred corn plants have an average height that is between 1.0 and 1.5 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female inbred corn plants have an average height that is between 1.5 and 2.0 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female inbred corn plants have an average height that is between 0.5 and 2.0 meters shorter than the height of the at least one male inbred corn plant, and then harvesting the hybrid corn seeds produced by one or more of the female inbred corn plants. According to some of these aspect, the at least one male inbred corn plant and the plurality of female inbred corn plants may be planted in rows as provided herein.

In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has an average height that is at least 2.5% lower than the height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 2.5% lower than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has an average height that is at least 5% lower than the height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 5% lower than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has an average height that is at least 10% lower than the height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 10% lower than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has an average height that is at least 12.5% lower than the height of the at least one male inbred corn plant, and then harvesting the hybrid corn seeds produced by the at least one female inbred corn plant. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 12.5% lower than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has an average height that is at least 15% lower than the height of the at least one male inbred corn plant, and then harvesting the hybrid corn seeds produced by the at least one female inbred corn plant. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 15% lower than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has an average height that is at least 17.5% lower than the height of the at least one male inbred corn plant, and then harvesting the hybrid corn seeds produced by the at least one female inbred corn plant. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 17.5% lower than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has an average height that is at least 20% lower than the height of the at least one male inbred corn plant, and then harvesting the hybrid corn seeds produced by the at least one female inbred corn plant. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 20% lower than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has an average height that is at least 25% lower than the height of the at least one male inbred corn plant, and then harvesting the hybrid corn seeds produced by the at least one female inbred corn plant. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 25% lower than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has an average height that is at least 30% lower than the height of the at least one male inbred corn plant, and then harvesting the hybrid corn seeds produced by the at least one female inbred corn plant. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 30% lower than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has an average height that is at least 35% lower than the height of the at least one male inbred corn plant, and then harvesting the hybrid corn seeds produced by the at least one female inbred corn plant. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 35% lower than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has an average height that is at least 40% lower than the height of the at least one male inbred corn plant, and then harvesting the hybrid corn seeds produced by the at least one female inbred corn plant. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 40% lower than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has an average height that is at least 45% lower than the height of the at least one male inbred corn plant, and then harvesting the hybrid corn seeds produced by the at least one female inbred corn plant. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 45% lower than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has an average height that is at least 50% lower than the height of the at least one male inbred corn plant, and then harvesting the hybrid corn seeds produced by the at least one female inbred corn plant. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 50% lower than the height of the at least one male inbred corn plant, and then harvesting the hybrid corn seeds produced by one or more of the female inbred corn plants.

In an aspect, this disclosure provides a method of crossing at least one male inbred corn plant with at least one female inbred corn plant to produce hybrid corn seeds by fertilizing the at least one female inbred corn plant with pollen from the at least one male corn plant, where the female-to-male plant height ratio is 0.98:1 or less, and then harvesting the hybrid corn seeds produced by the at least one female inbred corn plant. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female-to-male plant height ratio is 0.98:1 or less, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the female-to-male plant height ratio is 0.95:1 or less, and then harvesting the hybrid corn seeds produced by the at least one female inbred corn plant. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female-to-male plant height ratio is 0.95:1 or less, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the female-to-male plant height ratio is 0.9:1 or less, and then harvesting the hybrid corn seeds produced by the at least one female inbred corn plant. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female-to-male plant height ratio is 0.9:1 or less, and then harvesting the hybrid corn seeds produced by one or more of the female inbred corn plants. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female-to-male plant height ratio is 0.85:1 or less, and then harvesting the hybrid corn seeds produced by one or more of the female inbred corn plants. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female-to-male plant height ratio is 0.8:1 or less, and then harvesting the hybrid corn seeds produced by one or more of the female inbred corn plants. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female-to-male plant height ratio is 0.75:1 or less, and then harvesting the hybrid corn seeds produced by one or more of the female inbred corn plants. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female-to-male plant height ratio is 0.7:1 or less, and then harvesting the hybrid corn seeds produced by one or more of the female inbred corn plants. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female-to-male plant height ratio is 0.65:1 or less, and then harvesting the hybrid corn seeds produced by one or more of the female inbred corn plants. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female-to-male plant height ratio is 0.6:1 or less, and then harvesting the hybrid corn seeds produced by one or more of the female inbred corn plants. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female-to-male plant height ratio is 0.55:1 or less, and then harvesting the hybrid corn seeds produced by one or more of the female inbred corn plants. In an aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female-to-male plant height ratio is 0.5:1 or less, and then harvesting the hybrid corn seeds produced by one or more of the female inbred corn plants.

In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has a height (or average height) that is at least 0.1 meters or at least 0.2 meters shorter than the average height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 0.1 meters or at least 0.2 meters shorter than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has a height (or average height) that is at least 0.3 meters shorter than the average height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 0.3 meters shorter than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has a height (or average height) that is at least 0.4 meters shorter than the average height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 0.4 meters shorter than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has a height (or average height) that is at least 0.5 meters shorter than the average height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 0.5 meters shorter than the height of the at least one male inbred corn plant, and then harvesting the hybrid corn seeds produced by one or more of the female inbred corn plants. In another aspect, this disclosure provides a method of crossing at least one male inbred corn plant with a plurality of female inbred corn plants to produce hybrid corn seeds by fertilizing the female inbred corn plants with pollen from the at least one male corn plant, where the plurality of female inbred corn plants have an average height that is at least 1.0 meters shorter than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has a height (or average height) that is at least 1.0 meters shorter than the average height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 1.5 meters shorter than the height of the at least one male inbred corn plant, and then harvesting the hybrid corn seeds produced by one or more of the female inbred corn plants. In an aspect, this disclosure provides a method of crossing at least one male inbred corn plant with at least one female inbred corn plant to produce hybrid corn seeds by fertilizing the at least one female inbred corn plant with pollen from the at least one male corn plant, where the at least one female inbred corn plant has a height (or average height) that is at least 1.5 meters shorter than the average height of the at least one male inbred corn plant, and then harvesting the hybrid corn seeds produced by the at least one female inbred corn plant. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is at least 2.0 meters shorter than the height of the at least one male inbred corn plant, and then harvesting the hybrid corn seeds produced by one or more of the female inbred corn plants.

In an aspect, this disclosure provides a method of planting at least one male inbred corn plant in proximity to a plurality of female inbred corn plants to produce hybrid corn seeds, where the female inbred corn plants have an average height that is between 0.1 and 0.5 meters or between 0.2 and 0.5 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female inbred corn plants have an average height that is between 0.5 and 1.0 meters shorter than the height of the at least one male inbred corn plant, and then harvesting the hybrid corn seeds produced by one or more of the female inbred corn plants. In an aspect, this disclosure provides a method of planting at least one male inbred corn plant in proximity to a plurality of female inbred corn plants to produce hybrid corn seeds, where the female inbred corn plants have an average height that is between 0.5 and 1.5 meters shorter than the height of the at least one male inbred corn plant, and then harvesting the hybrid corn seeds produced by one or more of the female inbred corn plants. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is between 1.0 and 1.5 meters shorter than the height of the at least one male inbred corn plant, and then harvesting the hybrid corn seeds produced by one or more of the female inbred corn plants. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is between 1.5 and 2.0 meters shorter than the height of the at least one male inbred corn plant by fertilizing the plurality of female inbred corn plants with pollen from the at least one male corn plant, and then harvesting the hybrid corn seeds produced by one or more of the female inbred corn plants. In another aspect, this disclosure provides a method of crossing at least one male inbred corn plant with a plurality of female inbred corn plants to produce hybrid corn seeds by fertilizing the plurality of female inbred corn plants with pollen from the at least one male corn plant, where the female inbred corn plants have an average height that is between 0.5 and 2.0 meters shorter than the height of the at least one male inbred corn plant, and then harvesting the hybrid corn seeds produced by one or more of the female inbred corn plants.

As used herein, the term "tassel skeletonization" (TSK) refers to under-developed male tassels or spikelets that become "skeletonized" by producing little to no pollen. Tassel skeletonization can result in fewer if any anthers developing on the affected parts of the tassel. Tassel skeletonization negatively impacts crop productivity and yield as the reproductive capacity of male corn plants to produce pollen is curtailed or eliminated. If the pollen shed is reduced from male plants, then fertilization of females and seed production will likely be reduced. In an aspect, TSK can be measured by the percentage of anthers that undergo dehiscence. As used herein, "dehiscence" refers to the release of pollen from an anther.

In an aspect, at least one male corn plant provided herein comprises at least 5% greater anther dehiscence as compared to a control male corn plant. In another aspect, a male corn plant provided herein comprises at least 10% greater anther dehiscence as compared to a control male corn plant. In another aspect, at least one male corn plant provided herein comprises at least 15% greater anther dehiscence as compared to a control male corn plant. In another aspect, at least one male corn plant provided herein comprises at least 20% greater anther dehiscence as compared to a control male corn plant. In another aspect, at least one male corn plant provided herein comprises at least 25% greater anther dehiscence as compared to a control male corn plant. In another aspect, at least one male corn plant provided herein comprises at least 30% greater anther dehiscence as compared to a control male corn plant. In another aspect, at least one male corn plant provided herein comprises at least 35% greater anther dehiscence as compared to a control male corn plant. In another aspect, at least one male corn plant provided herein comprises at least 40% greater anther dehiscence as compared to a control male corn plant. In another aspect, at least one male corn plant provided herein comprises at least 45% greater anther dehiscence as compared to a control male corn plant. In another aspect, at least one male corn plant provided herein comprises at least 50% greater anther dehiscence as compared to a control male corn plant. In another aspect, at least one male corn plant provided herein comprises at least 60% greater anther dehiscence as compared to a control male corn plant. In another aspect, at least one male corn plant provided herein comprises at least 70% greater anther dehiscence as compared to a control male corn plant. In another aspect, at least one male corn plant provided herein comprises at least 80% greater anther dehiscence as compared to a control male corn plant. In another aspect, at least one male corn plant provided herein comprises at least 90% greater anther dehiscence as compared to a control male corn plant. In another aspect, at least one male corn plant provided herein comprises at least 100% greater anther dehiscence as compared to a control male corn plant. In another aspect, at least one male corn plant provided herein comprises at least 150% greater anther dehiscence as compared to a control male corn plant. In another aspect, at least one male corn plant provided herein comprises at least 200% greater anther dehiscence as compared to a control male corn plant. In another aspect, at least one male corn plant provided herein comprises at least 250% greater anther dehiscence as compared to a control male corn plant. In another aspect, at least one male corn plant provided herein comprises at least 300% greater anther dehiscence as compared to a control male corn plant. In another aspect, at least one male corn plant provided herein comprises at least 400% greater anther dehiscence as compared to a control male corn plant. In another aspect, at least one male corn plant provided herein comprises at least 500% greater anther dehiscence as compared to a control male corn plant.

According to embodiments of the present disclosure, the anther dehiscence of a male corn plant and the average anther dehiscence of male corn plants as described herein may be at or during a late vegetative and/or a reproductive stage of development when tassel formation and extension, pollen shed, silking, pollination, and/or kernel or ear development occurs, such as V12, V13, V14, V15, Vn, VT, R1, R2, R3, R4, R5, and/or R6 stage, such as VT or R1 stage. If the developmental stage is not specified or stated, then the anther dehiscence of a male corn plant or the average anther dehiscence of male corn plants is at R1 stage.

In an aspect, TSK can be measured by the total number of anthers present on the tassel. In an aspect, at least one male corn plant provided herein comprises at least 5% more anthers as compared to a control male corn plant. In another aspect, at least one male corn plant provided herein comprises at least 10% more anthers as compared to a control male corn plant. In another aspect, at least one male corn plant provided herein comprises at least 15% more anthers as compared to a control male corn plant. In another aspect, at least one male corn plant provided herein comprises at least 20% more anthers as compared to a control male corn plant. In another aspect, at least one male corn plant provided herein comprises at least 25% more anthers as compared to a control male corn plant. In another aspect, at least one male corn plant provided herein comprises at least 30% more anthers as compared to a control male corn plant. In another aspect, at least one male corn plant provided herein comprises at least 35% more anthers as compared to a control male corn plant. In another aspect, at least one male corn plant provided herein comprises at least 40% more anthers as compared to a control male corn plant. In another aspect, at least one male corn plant provided herein comprises at least 45% more anthers as compared to a control male corn plant. In another aspect, at least one male corn plant provided herein comprises at least 50% more anthers as compared to a control male corn plant. In another aspect, at least one male corn plant provided herein comprises at least 60% more anthers as compared to a control male corn plant. In another aspect, at least one male corn plant provided herein comprises at least 70% more anthers as compared to a control male corn plant. In another aspect, at least one male corn plant provided herein comprises at least 80% more anthers as compared to a control male corn plant. In another aspect, at least one male corn plant provided herein comprises at least 90% more anthers as compared to a control male corn plant. In another aspect, at least one male corn plant provided herein comprises at least 100% more anthers as compared to a control male corn plant. In another aspect, at least one male corn plant provided herein comprises at least 150% more anthers as compared to a control male corn plant. In another aspect, at least one male corn plant provided herein comprises at least 200% more anthers as compared to a control male corn plant. In another aspect, at least one male corn plant provided herein comprises at least 250% more anthers as compared to a control male corn plant. In another aspect, at least one male corn plant provided herein comprises at least 300% more anthers as compared to a control male corn plant. In another aspect, at least one male corn plant provided herein comprises at least 400% more anthers as compared to a control male corn plant. In another aspect, at least one male corn plant provided herein comprises at least 500% more anthers as compared to a control male corn plant.

According to embodiments of the present disclosure, the number of anthers of (or on) a male corn plant and the average number of anthers of (or on) male corn plants as described herein may be at or during a late vegetative and/or a reproductive stage of development when tassel formation and extension, pollen shed, silking, pollination, and/or kernel or ear development occurs, such as V12, V13, V14, V15, Vn, VT, R1, R2, R3, R4, R5, and/or R6 stage, such as VT or R1 stage. If the developmental stage is not specified or stated, then the number of anthers of (or on) a male corn plant or the average number of anthers of (or on) male corn plants is at R1 stage.

Tassel skeletonization can result in a reduced number of tassel branches. In an aspect, TSK can be measured by the total number of tassel branches. In an aspect, at least one male corn plant provided herein comprises at least 5% more tassel branches as compared to a control male corn plant. In another aspect, at least one male corn plant provided herein comprises at least 10% more tassel branches as compared to a control male corn plant. In another aspect, at least one male corn plant provided herein comprises at least 15% more tassel branches as compared to a control male corn plant. In another aspect, at least one male corn plant provided herein comprises at least 20% more tassel branches as compared to a control male corn plant. In another aspect, at least one male corn plant provided herein comprises at least 25% more tassel branches as compared to a control male corn plant. In another aspect, at least one male corn plant provided herein comprises at least 30% more tassel branches as compared to a control male corn plant. In another aspect, at least one male corn plant provided herein comprises at least 35% more tassel branches as compared to a control male corn plant. In another aspect, at least one male corn plant provided herein comprises at least 40% more tassel branches as compared to a control male corn plant. In another aspect, at least one male corn plant provided herein comprises at least 45% more tassel branches as compared to a control male corn plant. In another aspect, at least one male corn plant provided herein comprises at least 50% more tassel branches as compared to a control male corn plant. In another aspect, at least one male corn plant provided herein comprises at least 60% more tassel branches as compared to a control male corn plant. In another aspect, at least one male corn plant provided herein comprises at least 70% more tassel branches as compared to a control male corn plant. In another aspect, at least one male corn plant provided herein comprises at least 80% more tassel branches as compared to a control male corn plant. In another aspect, at least one male corn plant provided herein comprises at least 90% more tassel branches as compared to a control male corn plant. In another aspect, at least one male corn plant provided herein comprises at least 100% more tassel branches as compared to a control male corn plant. In another aspect, at least one male corn plant provided herein comprises at least 150% more tassel branches as compared to a control male corn plant. In another aspect, at least one male corn plant provided herein comprises at least 200% more tassel branches as compared to a control male corn plant. In another aspect, at least one male corn plant provided herein comprises at least 250% more tassel branches as compared to a control male corn plant. In another aspect, at least one male corn plant provided herein comprises at least 300% more tassel branches as compared to a control male corn plant. In another aspect, at least one male corn plant provided herein comprises at least 400% more tassel branches as compared to a control male corn plant. In another aspect, at least one male corn plant provided herein comprises at least 500% more tassel branches as compared to a control male corn plant.

According to embodiments of the present disclosure, the number of tassel branches of (or on) a male corn plant and the average number of tassel branches of (or on) male corn plants as described herein may be at or during a late vegetative and/or a reproductive stage of development when tassel formation and extension, pollen shed, silking, pollination, and/or kernel or ear development occurs, such as V12, V13, V14, V15, Vn, VT, R1, R2, R3, R4, R5, and/or R6 stage, such as VT or R1 stage. If the developmental stage is not specified or stated, then the number of tassel branches of (or on) a male corn plant or the average number of tassel branches of (or on) male corn plants is at R1 stage.

Tassel skeletonization can result in a reduction of tassel branch length. In an aspect, TSK can be measured by the average length of tassel branches. In an aspect, at least one male corn plant provided herein comprises at least 5% longer tassel branches as compared to a control male corn plant. In another aspect, at least one male corn plant provided herein comprises at least 10% longer tassel branches as compared to a control male corn plant. In another aspect, at least one male corn plant provided herein comprises at least 15% longer tassel branches compared to a control male corn plant. In another aspect, at least one male corn plant provided herein comprises at least 20% longer tassel branches as compared to a control male corn plant. In another aspect, at least one male corn plant provided herein comprises at least 25% longer tassel branches as compared to a control male corn plant. In another aspect, at least one male corn plant provided herein comprises at least 30% longer tassel branches as compared to a control male corn plant. In another aspect, at least one male corn plant provided herein comprises at least 35% longer tassel branches as compared to a control male corn plant. In another aspect, at least one male corn plant provided herein comprises at least 40% longer tassel branches as compared to a control male corn plant. In another aspect, at least one male corn plant provided herein comprises at least 45% longer tassel branches as compared to a control male corn plant. In another aspect, at least one male corn plant provided herein comprises at least 50% longer tassel branches as compared to a control male corn plant. In another aspect, at least one male corn plant provided herein comprises at least 60% longer tassel branches as compared to a control male corn plant. In another aspect, at least one male corn plant provided herein comprises at least 70% longer tassel branches as compared to a control male corn plant. In another aspect, at least one male corn plant provided herein comprises at least 80% longer tassel branches as compared to a control male corn plant. In another aspect, at least one male corn plant provided herein comprises at least 90% longer tassel branches as compared to a control male corn plant. In another aspect, at least one male corn plant provided herein comprises at least 100% longer tassel branches as compared to a control male corn plant. In another aspect, at least one male corn plant provided herein comprises at least 150% longer tassel branches as compared to a control male corn plant. In another aspect, at least one male corn plant provided herein comprises at least 200% longer tassel branches as compared to a control male corn plant. In another aspect, at least one male corn plant provided herein comprises at least 250% longer tassel branches as compared to a control male corn plant. In another aspect, at least one male corn plant provided herein comprises at least 300% longer tassel branches as compared to a control male corn plant. In another aspect, at least one male corn plant provided herein comprises at least 400% longer tassel branches as compared to a control male corn plant. In another aspect, at least one male corn plant provided herein comprises at least 500% longer tassel branches as compared to a control male corn plant.

According to embodiments of the present disclosure, the length of tassel branches of (or on) a male corn plant and the average length of tassel branches of (or on) male corn plants as described herein may be at or during a late vegetative and/or a reproductive stage of development when tassel formation and extension, pollen shed, silking, pollination, and/or kernel or ear development occurs, such as V12, V13, V14, V15, Vn, VT, R1, R2, R3, R4, R5, and/or R6 stage, such as VT or R1 stage. If the developmental stage is not specified or stated, then the length of tassel branches of (or on) a male corn plant or the average length of tassel branches of (or on) male corn plants is at R1 stage.

In an aspect, TSK can be measured using a "TSK scoring guide," which scores corn plants on a 1-10 scale based on the percentage of tassels on the plant that are skeletonized (e.g., a corn plant with less than or equal to 10% of its tassels being skeletonized is given a score of 1, a plant with approximately 50% of its tassels being skeletonized is given a score of 5, a plant with about 90% of its tassels being skeletonized is given a score of 9, etc.). In an aspect, at least one male corn plant that is planted near one or more female corn plants of a lesser height as provided herein has a TSK score that is improved (decreased) by at least 1 unit according to the TSK scoring guide, in comparison to at least one male control corn plant (i.e., at least one male corn plant of the same inbred line that is planted at the same density next to, and surrounded by, other corn plants of the same or similar height). In an aspect, at least one male corn plant provided herein has a TSK score that is improved (decreased) by at least 2 units as measured by using the TSK scoring guide in comparison to a control plant. In an aspect, at least one male corn plant provided herein has a TSK score that is improved (decreased) by at least 3 units as measured by using the TSK scoring guide in comparison to a control plant. In an aspect, at least one male corn plant provided herein has a TSK score that is improved (decreased) by at least 4 units as measured by using the TSK scoring guide in comparison to a control plant. In an aspect, at least one male corn plant provided herein has a TSK score that is improved (decreased) by at least 5 units as measured by using the TSK scoring guide in comparison to a control plant. In an aspect, at least one male corn plant provided herein has a TSK score that is improved (decreased) by at least 6 units as measured by using the TSK scoring guide in comparison to a control plant. In an aspect, at least one male corn plant provided herein has a TSK score that is improved (decreased) by at least 7 units as measured by using the TSK scoring guide in comparison to a control plant. In an aspect, at least one male corn plant provided herein has a TSK score that is improved (decreased) by at least 8 units as measured by using the TSK scoring guide in comparison to a control plant. In an aspect, at least one male corn plant provided herein has a TSK score that is improved (decreased) by at least 9 units as measured by using the TSK scoring guide in comparison to a control plant.

According to embodiments of the present disclosure, the TSK score of (or on) a male corn plant and the average TSK score of (or on) male corn plants as described herein may be at or during a late vegetative and/or a reproductive stage of development when tassel formation and extension, pollen shed, silking, pollination, and/or kernel or ear development occurs, such as V12, V13, V14, V15, Vn, VT, R1, R2, R3, R4, R5, and/or R6 stage, such as VT or R1 stage. If the developmental stage is not specified or stated, then the TSK score of (or on) a male corn plant or the average TSK score of (or on) male corn plants is at R1 stage.

In an aspect, this disclosure provides a corn field comprising at least two male inbred corn plants and at least two female inbred corn plants, where the female inbred corn plants are at least 10% shorter in average height than the male inbred corn plants, and further where the male inbred corn plants exhibit at least 10% less tassel skeletonization as compared to the tassel skeletonization exhibited by control male inbred corn plants in a corn field comprising at least two control male inbred corn plants and at least two control female inbred corn plants where the control male and female inbred corn plants do not differ in height by more than 5%. In an aspect, male inbred corn plants provided herein exhibit at least 12.5% less tassel skeletonization as compared to control male inbred corn plants. In an aspect, male inbred corn plants provided herein exhibit at least 15% less tassel skeletonization as compared to control male inbred corn plants. In an aspect, male inbred corn plants provided herein exhibit at least 17.5% less tassel skeletonization as compared to control male inbred corn plants. In an aspect, male inbred corn plants provided herein exhibit at least 20% less tassel skeletonization as compared to control male inbred corn plants. In an aspect, male inbred corn plants provided herein exhibit at least 25% less tassel skeletonization as compared to control male inbred corn plants. In an aspect, male inbred corn plants provided herein exhibit at least 30% less tassel skeletonization as compared to control male inbred corn plants. In an aspect, male inbred corn plants provided herein exhibit at least 35% less tassel skeletonization as compared to control male inbred corn plants. In an aspect, male inbred corn plants provided herein exhibit at least 40% less tassel skeletonization as compared to control male inbred corn plants. In an aspect, male inbred corn plants provided herein exhibit at least 45% less tassel skeletonization as compared to control male inbred corn plants. In an aspect, male inbred corn plants provided herein exhibit at least 50% less tassel skeletonization as compared to control male inbred corn plants. In an aspect, male inbred corn plants provided herein exhibit at least 55% less tassel skeletonization as compared to control male inbred corn plants. In an aspect, male inbred corn plants provided herein exhibit at least 60% less tassel skeletonization as compared to control male inbred corn plants. In an aspect, male inbred corn plants provided herein exhibit at least 65% less tassel skeletonization as compared to control male inbred corn plants. In an aspect, male inbred corn plants provided herein exhibit at least 70% less tassel skeletonization as compared to control male inbred corn plants. In an aspect, male inbred corn plants provided herein exhibit at least 75% less tassel skeletonization as compared to control male inbred corn plants. In an aspect, male inbred corn plants provided herein exhibit at least 80% less tassel skeletonization as compared to control male inbred corn plants. In an aspect, male inbred corn plants provided herein exhibit at least 85% less tassel skeletonization as compared to control male inbred corn plants. In an aspect, male inbred corn plants provided herein exhibit at least 90% less tassel skeletonization as compared to control male inbred corn plants. In an aspect, male inbred corn plants provided herein exhibit at least 95% less tassel skeletonization as compared to control male inbred corn plants. In an aspect, male inbred corn plants provided herein exhibit 100% less tassel skeletonization as compared to control male inbred corn plants.

According to embodiments of the present disclosure, the tassel skeletonization of (or on) a male corn plant and the average tassel skeletonization of (or on) male corn plants as described herein may be at or during a late vegetative and/or a reproductive stage of development when tassel formation and extension, pollen shed, silking, pollination, and/or kernel or ear development occurs, such as V12, V13, V14, V15, Vn, VT, R1, R2, R3, R4, R5, and/or R6 stage, such as VT or R1 stage. If the developmental stage is not specified or stated, then the tassel skeletonization of (or on) a male corn plant or the average tassel skeletonization of (or on) male corn plants is at R1 stage.

In an aspect, this disclosure provides a method of reducing tassel skeletonization by providing a corn field comprising at least two male inbred corn plants and at least two female inbred corn plants, where the female inbred corn plants are 10% shorter in average height than the male inbred corn plants, and further where the male inbred corn plants exhibit between 10% and 20% less tassel skeletonization as compared to the tassel skeletonization exhibited by control male inbred corn plants in a corn field comprising control male inbred corn plants and control female inbred corn plants where the control male and female inbred corn plants do not differ in height by more than 5%. In an aspect, male inbred corn plants provided herein exhibit between 10% and 30% less tassel skeletonization as compared to control male inbred corn plants. In an aspect, male inbred corn plants provided herein exhibit between 10% and 40% less tassel skeletonization as compared to control male inbred corn plants. In an aspect, male inbred corn plants provided herein exhibit between 10% and 50% less tassel skeletonization as compared to control male inbred corn plants. In an aspect, male inbred corn plants provided herein exhibit between 10% and 60% less tassel skeletonization as compared to control male inbred corn plants. In an aspect, male inbred corn plants provided herein exhibit between 10% and 70% less tassel skeletonization as compared to control male inbred corn plants. In an aspect, male inbred corn plants provided herein exhibit between 10% and 80% less tassel skeletonization as compared to control male inbred corn plants. In an aspect, male inbred corn plants provided herein exhibit between 10% and 90% less tassel skeletonization as compared to control male inbred corn plants. In an aspect, male inbred corn plants provided herein exhibit between 10% and 100% less tassel skeletonization as compared to control male inbred corn plants. In an aspect, male inbred corn plants provided herein exhibit between 20% and 30% less tassel skeletonization as compared to control male inbred corn plants. In an aspect, male inbred corn plants provided herein exhibit between 20% and 40% less tassel skeletonization as compared to control male inbred corn plants. In an aspect, male inbred corn plants provided herein exhibit between 20% and 50% less tassel skeletonization as compared to control male inbred corn plants. In an aspect, male inbred corn plants provided herein exhibit between 20% and 60% less tassel skeletonization as compared to control male inbred corn plants. In an aspect, male inbred corn plants provided herein exhibit between 20% and 70% less tassel skeletonization as compared to control male inbred corn plants. In an aspect, male inbred corn plants provided herein exhibit between 20% and 80% less tassel skeletonization as compared to control male inbred corn plants. In an aspect, male inbred corn plants provided herein exhibit between 20% and 90% less tassel skeletonization as compared to control male inbred corn plants. In an aspect, male inbred corn plants provided herein exhibits between 20% and 100% less tassel skeletonization as compared to control male inbred corn plants. In an aspect, male inbred corn plants provided herein exhibit between 30% and 50% less tassel skeletonization as compared to control male inbred corn plants. In an aspect, male inbred corn plants provided herein exhibit between 30% and 80% less tassel skeletonization as compared to control male inbred corn plants. In an aspect, male inbred corn plants provided herein exhibit between 30% and 100% less tassel skeletonization as compared to control male inbred corn plants. In an aspect, male inbred corn plants provided herein exhibit between 50% and 70% less tassel skeletonization as compared to control male inbred corn plants. In an aspect, male inbred corn plants provided herein exhibit between 60% and 80% less tassel skeletonization as compared to control male inbred corn plants. In an aspect, male inbred corn plants provided herein exhibit between 70% and 90% less tassel skeletonization as compared to control male inbred corn plants. In an aspect, male inbred corn plants provided herein exhibit between 50% and 100% less tassel skeletonization as compared to control male inbred corn plants.

According to an aspect of the present disclosure, one or more male corn plants can be made "taller" or higher by raising the male plants (or base of the male plants) relative to the female corn plants. This could be done regardless of whether the female plants are shorter than the male plants—i.e., the female plants may be taller or shorter than, or about the same height as, the male plants when the male plants have not been raised, but the top(s) of the male plants would be higher than the tops of the female plants when the male plants are raised relative to the surrounding soil or ground. For example, male plants may be planted in ground, earth or soil that is mounded or raised relative to the ground, earth or soil in which the female plants are planted, such that the tassels of the male plants are higher than the tops of the female plants. As another example, male plants may be planted in pots or containers to raise their height relative to the female plants. Conversely, a similar effect could be achieved if the female corn plant(s) are lowered relative to the male corn plant(s). For example, the female corn plants may be planted in furrows or valleys or at lower elevations or downslope relative to the male corn plants.

According to these embodiments, when a male plant(s) is/are raised relative to one or more female plants, the effective height(s) or effective average height(s) of the male plants is/are calculated and defined as including the raised height relative to the top surface of the surrounding soil or ground in addition to the actual height of the male plant(s). Likewise, if female corn plants are lowered relative to one or more male plants, the effective height(s) or effective average height(s) of the female plants is/are calculated and defined by subtracting from the actual height of the female plant, the lowered height of the female plant(s) relative to the top surface of the surrounding soil or ground (e.g., the surrounding soil or ground where the male plants are located or planted). For example, if the actual height of a corn plant is 3 meters, but the corn plant is raised 0.5 meters above the top surface of the surrounding soil or ground, then the effective height of the corn plant is 3.5 meters, but if such a plant is not raised relative to the top surface of the surrounding soil or ground, then the effective height of the plant is equal to its actual height. As another example, if the actual height of a corn plant is 3 meters, but the corn plant is lowered 0.5 meters below the top surface of the surrounding soil or ground, then the effective height of the corn plant is 2.5 meters. According to present embodiments, all of the description provided herein in reference to individual or average plant height(s), and relative plant height(s) of male and female corn plants, shall be equally and fully applicable to the effective plant height(s) or average effective plant height(s) of raised or lowered plants.

According to some aspects, the difference in plant height and/or placement (or average plant height and/or placement) between the male and female corn plants may be described as the difference in height or elevation of a particular structural or anatomical feature. In terms of placement, the relative height or elevation of the particular structural or anatomical feature, such as the ligule or collar or uppermost leaf surface, may provide an alternative or additional basis to describe the effective height of a plant that is raised or lowered relative to other plants. In an aspect, the average height of the ligule or collar of the uppermost fully expanded leaf and/or the uppermost leaf surface of the female inbred corn plants is at least 2% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 2.5% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 3% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 3.5% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 4% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 4.5% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 5% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 7.5% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 10% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 15% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 20% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 25% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 30% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 35% less or lower than the height (or average height) of the ligule or collar of at least one male inbred corn plant(s) (or the average plant height of male inbred corn plants). In an aspect, the average height of the ligule or collar of the uppermost fully expanded leaf and/or the uppermost leaf surface of the female inbred corn plants is at least 40% less or lower than the height (or average height) of the ligule or collar of at least one male inbred corn plant(s) (or the average plant height of male inbred corn plants).

The following non-limiting embodiments are specifically envisioned:

1. A method comprising:
   (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_3 locus, wherein the mutant allele comprises a DNA segment inserted into the endogenous GA20 oxidase_3 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_3 locus produces a RNA transcript comprising the antisense RNA sequence; and
   (b) harvesting said hybrid corn seeds from one or more of the female inbred corn plants.
2. A method comprising:
   (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a DNA segment inserted into the endogenous GA20 oxidase_5 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_5 locus produces a RNA transcript comprising the antisense RNA sequence; and
   (b) harvesting said hybrid corn seeds from one or more of the female inbred corn plants.
3. A method comprising:
   (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of an endogenous Brachytic2 (br2) locus, wherein the mutant allele comprises a DNA segment inserted into the endogenous br2 locus, wherein the DNA segment encodes an antisense RNA that is at least 70% complementary to at least 20 consecutive nucleotides of SEQ ID NO: 132 or 180, and wherein the mutant allele of the endogenous br2 locus produces an RNA transcript comprising the antisense RNA sequence; and (b) harvesting said hybrid corn seeds from one or more of the female inbred corn plants.

4. A method comprising:

(c) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of an endogenous Brachytic2 (br2) locus, wherein the mutant allele comprises a deletion of at least one nucleotide from an endogenous br2 locus as compared to SEQ ID NO: 132; and (d) harvesting said hybrid corn seeds from one or more of the female inbred corn plants.

5. A method comprising:

(a) fertilizing a plurality of female inbred corn plants with pollen from at least one male inbred corn plant to produce hybrid corn seeds, wherein the female inbred corn plants comprise a short stature phenotype exhibited by an average height that is at least 2.5% lower than the average height of the at least one male inbred corn plant, wherein the female inbred corn plants comprise a dominant or semi-dominant transgene or mutant allele of a gene, and wherein the transgene or mutant allele causes the short stature phenotype of the female inbred corn plants; and (b) harvesting said hybrid corn seeds from one or more of the female inbred corn plants.

6. A method comprising:

(a) fertilizing a plurality of female inbred corn plants with pollen from at least one male inbred corn plant to produce hybrid corn seeds, wherein the female inbred corn plants comprise a short stature phenotype exhibited by an average height that is at least 2.5% lower than the average height of the at least one male inbred corn plant, wherein the female inbred corn plants comprise a premature stop codon within a nucleic acid sequence encoding a Brachytic2 protein as compared to a control corn plant; and (b) harvesting said hybrid corn seeds from one or more of the female inbred corn plants.

7. The method of embodiment 1, wherein the mutant allele of the endogenous GA20 oxidase_3 locus suppresses the expression of a wild-type allele of the endogenous GA20 oxidase_3 locus, a wild-type allele of the endogenous GA20 oxidase_5 locus, or both.

8. The method of embodiment 1, wherein the DNA segment comprises a nucleotide sequence originating from the endogenous GA20 oxidase_3 locus.

9. The method of embodiment 1, wherein the DNA segment corresponds to an inverted genomic fragment of the endogenous GA20 oxidase_3 locus.

10. The method of embodiment 1, wherein the DNA segment comprises a nucleotide sequence originating from an endogenous GA20 oxidase_5 locus.

11. The method of any one of embodiments 1-3, wherein at least a portion of the antisense RNA sequence is at least 70% complementary to a corresponding endogenous sequence of the RNA transcript.

12. The method of embodiment 11, wherein the corresponding endogenous sequence of the RNA transcript is at least 85% identical to at least 20 consecutive nucleotides of one or more of SEQ ID NOs: 182-184 and 186-188.

13. The method of embodiment 1, wherein the DNA segment is inserted near or adjacent to a corresponding endogenous DNA segment of the endogenous GA20 oxidase_3 locus or the endogenous GA20 oxidase_5 locus.

14. The method of embodiment 13, wherein the antisense RNA sequence forms a stem-loop structure with the corresponding endogenous sequence of the RNA transcript.

15. The method of embodiment 13, wherein the inserted DNA segment and the corresponding endogenous DNA segment of the mutant allele are separated by an intervening DNA sequence.

16. The method of embodiment 15, wherein the intervening DNA sequence comprises a native sequence of the endogenous GA20 oxidase_3 locus.

17. The method of embodiment 15, wherein the intervening DNA sequence comprises an exogenous sequence inserted into the endogenous GA20 oxidase_3 locus.

18. The method of embodiment 11, wherein the DNA segment is inserted within a region selected from the group consisting of 5' untranslated region (UTR), $1^{st}$ exon, $1^{st}$ intron, $2^{nd}$ exon, $2^{nd}$ intron, $3^{rd}$ exon and 3' UTR of the endogenous GA20 oxidase_3 locus, and a combination thereof 19. The method of embodiment 11, wherein the DNA segment is inserted at a genomic site recognized by a targeted editing technique to create a double-stranded break (DSB).

20. The method of embodiment 11, wherein the mutant allele further comprises a deletion of at least one portion of the endogenous GA20 oxidase_3 locus.

21. The method of embodiment 11, wherein the sense strand of the DNA segment comprises a sequence at least 70% complementary to an exon sequence of the endogenous GA20 oxidase_3 or GA20 oxidase_5 locus.

22. The method of embodiment 11, wherein the sense strand of the DNA segment comprises a sequence at least 70% complementary to an untranslated region (UTR) sequence of the endogenous GA20 oxidase_3 or GA20 oxidase_5 locus.

23. The method of embodiment 11, wherein the sense strand of the DNA segment comprises a sequence at least 70% complementary to an exon sequence and an intron sequence of the endogenous GA20 oxidase_3 or GA20 oxidase_5 locus, the exon sequence and the intron sequence being contiguous within the endogenous locus.

24. The method of embodiment 11, wherein the DNA segment comprises a sequence having at least at least 70% identity to one or more of SEQ ID Nos: 194, 195, 207, 209, 211, 213, and 217.

25. The method of embodiment 2, wherein the mutant allele of the endogenous GA20 oxidase_5 locus suppresses the expression of a wild-type allele of the endogenous GA20 oxidase_3 locus, a wild-type allele of the endogenous GA20 oxidase_5 locus, or both.

26. The method of embodiment 2, wherein the RNA transcript further comprises one or more sequence elements of the endogenous GA20 oxidase_5 locus selected from the group consisting of 5' UTR, $1^{st}$ exon, $1^{st}$ intron, $2^{nd}$ exon, $2^{nd}$ intron, $3^{rd}$ exon, 3' UTR, and any portion thereof.

27. The method of embodiment 2, wherein the DNA segment comprises a nucleotide sequence originating from an endogenous GA20 oxidase_3 locus.

28. The method of embodiment 27, wherein the DNA segment corresponds to an inverted genomic fragment of the endogenous GA20 oxidase_3 locus.

29. The method of embodiment 2, wherein the DNA segment comprises a nucleotide sequence originating from the endogenous GA20 oxidase_5 locus.

30. The method of embodiment 29, wherein the DNA segment corresponds to an inverted genomic fragment of the endogenous GA20 oxidase_5 locus.

31. The method of embodiment 2, wherein the DNA segment is inserted near or adjacent to a corresponding endogenous DNA segment of the endogenous GA20 oxidase_5 locus.

32. The method of embodiment 31, wherein the inserted DNA segment and the corresponding endogenous DNA segment of the mutant allele are separated by an intervening DNA sequence.

33. The method of embodiment 32, wherein the intervening DNA sequence comprises a native sequence of the endogenous GA20 oxidase_5 locus.

34. The method of embodiment 32, wherein the intervening DNA sequence comprises an exogenous sequence inserted into the endogenous GA20 oxidase_5 locus.

35. The method of embodiment 1 or 2, wherein the level of one or more active GAs in at least one internode tissue of the stem or stalk of the modified corn plant is lower than the same internode tissue of an unmodified control plant.

36. The method of embodiment 3, wherein the mutant allele of the endogenous br2 locus suppresses the expression of a wild-type allele of the endogenous br2 locus.

37. The method of embodiment 3, wherein the mutant allele product of the endogenous br2 locus disrupts the function of a wild-type allele product of the endogenous br2 locus.

38. The method of embodiment 3, wherein the RNA transcript further comprises one or more sequence elements of the endogenous br2 locus selected from the group consisting of 5'UTR, first exon, first intron, second exon, second intron, third exon, third intron, fourth exon, fourth intron, fifth exon, 3' UTR, and any portion thereof 39. The method of embodiment 3, wherein the DNA segment comprises a nucleotide sequence originating from the endogenous br2 locus.

40. The method of embodiment 39, wherein the DNA segment corresponds to an inverted genomic fragment of the endogenous br2 locus.

41. The method of embodiment 3, wherein at least a portion of the antisense RNA sequence is at least 70% complementary to a corresponding endogenous sequence of the RNA transcript.

42. The method of embodiment 41, wherein the corresponding endogenous sequence of the RNA transcript is at least 85% identical to at least 20 consecutive nucleotides of SEQ ID NO: 132 or 180.

43. The method of embodiment 42, wherein the antisense RNA sequence hybridizes to the corresponding endogenous sequence of the RNA transcript.

44. The method of any one of embodiments 41-43, wherein the DNA segment is inserted near or adjacent to a corresponding endogenous DNA segment of the endogenous br2 locus.

45. The method of embodiment 44, wherein the antisense RNA sequence encoded by the inserted DNA segment hybridizes to a corresponding endogenous sequence of the RNA transcript encoded by the corresponding endogenous DNA segment.

46. The method of embodiment 44 or 45, wherein the antisense RNA sequence forms a stem-loop structure with the corresponding endogenous sequence of the RNA transcript.

47. The method of embodiment 44, wherein the inserted DNA segment and the corresponding endogenous DNA segment of the mutant allele are separated by an intervening DNA sequence.

48. The method of embodiment 47, wherein the intervening DNA sequence has a length of at least 2 consecutive nucleotides.

49. The method of embodiment 47, wherein the DNA segment and the corresponding endogenous DNA segment are separated by an intervening sequence of at most 4000 consecutive nucleotides.

50. The method of any one of embodiments 47-49, wherein the intervening DNA sequence encodes an intervening RNA sequence between the antisense RNA sequence and the corresponding endogenous sequence of the RNA transcript.

51. The method of embodiment 50, wherein the RNA transcript forms a stem-loop secondary structure with the intervening RNA sequence forming the loop portion of the stem-loop secondary structure.

52. The method of embodiment 51, wherein the stem-loop secondary structure comprises a near-perfect-complement stem with mismatches.

53. The method of embodiment 51, wherein the stem-loop secondary structure comprises a perfect-complement stem with no mismatch.

54. The method of any one of embodiments 47-53, wherein the intervening DNA sequence comprises a native sequence of the endogenous br2 locus.

55. The method of any one of embodiments 47-53, wherein the intervening DNA sequence comprises an exogenous sequence inserted into the endogenous br2 locus.

56. The method of any one of embodiments 47-53, wherein the intervening DNA sequence comprises an intron sequence.

57. The method of any one of embodiments 47-53, wherein the intervening DNA sequence does not comprise an intron sequence.

58. The method of embodiment 44, wherein the inserted DNA segment is located upstream of the corresponding endogenous DNA segment.

59. The method of embodiment 44, wherein the inserted DNA segment is located downstream of the corresponding endogenous DNA segment.

60. The method of embodiment 41, wherein the DNA segment is inserted within a region selected from the group consisting of 5' untranslated region (UTR), first exon, first intron, second exon, second intron, third exon, third intron, fourth exon, fourth intron, fifth exon, and 3' UTR of the endogenous br2 locus, and a combination thereof.

61. The method of embodiment 41, wherein the mutant allele further comprises a deletion of at least one portion of the endogenous br2 locus.

62. The method of embodiment 41, wherein the sense strand of the DNA segment comprises a sequence at least 70% complementary to an exon sequence of the endogenous br2 locus.

63. The method of embodiment 41, wherein the sense strand of the DNA segment comprises a sequence at least 70% complementary to an untranslated region (UTR) sequence of the endogenous br2 locus.

64. The method of embodiment 41, wherein the sense strand of the DNA segment comprises a sequence at least 70% complementary to an exon sequence and an intron sequence of the endogenous br2 locus, the exon sequence and the intron sequence being contiguous within the endogenous locus.

65. The method of embodiment 41, wherein the DNA segment comprises a sequence having at least at least 70% identity to one or more of SEQ ID Nos: 132 and 180.

66. The method of embodiment 3, wherein the DNA segment has a length of at least 15 nucleotides.

67. The method of embodiment 3, wherein the DNA segment has a length of at most 1000 nucleotides.

68. The method of embodiment 4, wherein the deletion further comprises the deletion of the at least one exon of the endogenous br2 locus as compared to SEQ ID NO: 132.

69. The method of embodiment 4, wherein the deletion further comprises the deletion of the endogenous br2 locus.

70. The method of embodiment 68, wherein the at least one exon is the first exon of the endogenous br2 locus.

71. The method of embodiment 68, wherein the at least one exon is the second exon of the endogenous br2 locus.

72. The method of embodiment 68, wherein the at least one exon is the third exon of the endogenous br2 locus.

73. The method of embodiment 68, wherein the at least one exon is the fourth exon of the endogenous br2 locus.

74. The method of embodiment 68, wherein the at least one exon is the fifth exon of the endogenous br2 locus.

75. The method of any one of embodiments 4 or 68-74, wherein the deletion further comprises a deletion of at least one nucleotide from at least one intron of the endogenous br2 locus.

76. The method of embodiment 75, wherein the deletion comprises the deletion of the at least one intron.

77. The method of any one of embodiments 4 or 68-76, wherein the deletion further comprises the deletion of at least one nucleotide of the 5'-untranslated region of the endogenous br2 locus.

78. The method of any one of embodiments 4 or 68-77, wherein the deletion further comprises the deletion of at least one nucleotide of the 3'-untranslated region of the endogenous br2 locus.

79. The method of embodiment 68, wherein the deletion further comprises the deletion of a second exon of the endogenous br2 locus.

80. The method of embodiment 79, wherein the two exons are contiguous exons.

81. The method of embodiment 79, wherein the two exons are not contiguous exons.

82. The method of embodiment 4, wherein the mutant allele encodes a truncated protein as compared to SEQ ID NO: 181.

83. The method of any one of embodiments 4 or 70-82, wherein the deletion comprises between 10 nucleotides and 8000 nucleotides.

84. The method of embodiment 4, wherein the mutant allele encodes an mRNA transcript comprising a premature stop codon as compared to SEQ ID NO: 180.

85. The method of embodiment 6, wherein a protein encoded by the nucleic acid sequence is truncated as compared to SEQ ID NO: 181.

86. The method of embodiment 6, wherein a protein encoded by the nucleic acid sequence comprises 1378 or fewer amino acids.

87. The method of embodiment 6, wherein the premature stop codon is present in a region of the nucleic acid sequence selected from the group consisting of the first exon, the second exon, the third exon, the fourth exon, and the fifth exon.

88. The method of any one of embodiments 6 or 85-87, wherein the premature stop codon results from a nonsense mutation.

89. The method of any one of embodiments 6 or 85-87, wherein the premature stop codon results from a missense mutation.

90. The method of embodiment 5, wherein the gene is a GA20 oxidase gene.

91. The method of embodiment 90, wherein the GA20 oxidase gene is a GA20 oxidase_3 gene.

92. The method of embodiment 90, wherein the GA20 oxidase is a GA20 oxidase_5 gene.

93. The method of embodiment 5, wherein the gene is a GA3 oxidase gene.

94. The method of embodiment 5, wherein the gene is a brachytic2 gene.

95. The method of embodiment 5, wherein the mutant allele is a dominant negative mutant allele.

96. The method of embodiment 95, wherein the dominant negative mutant allele generates an antisense RNA transcript capable of triggering suppression of an unmodified or wildtype allele of the gene.

97. The method of embodiment 95, wherein the dominant negative mutant allele encodes a truncated protein as compared to an unmodified allele of the gene.

98. The method of embodiment 95, wherein the dominant negative mutant allele generates at least one RNA transcript capable of forming a hairpin-loop secondary structure.

99. The method of embodiment 95, wherein the coding sequence of the dominant negative mutant allele is operably linked to a promoter of the native copy of the gene.

100. The method of embodiment 95, wherein the dominant negative mutant allele comprises an inverted copy of the gene, or a portion thereof, adjacent to a wildtype copy of the gene at the endogenous locus of the gene.

101. The method of embodiment 95, wherein the dominant negative mutant allele comprises a deletion of a portion of a chromosome between a first region of the gene and a second region of the gene, wherein an antisense RNA transcript of the first region of the gene is generated following the deletion of the portion of the chromosome.

102. The method of embodiment 95, wherein the dominant negative mutant allele comprises a first promoter and a second promoter separated by an intervening region, wherein the first promoter and the second promoter are positioned in opposite orientations, wherein the second promoter generates at least one antisense RNA transcript, and wherein expression of the gene is reduced as compared to a control corn plant that lacks the dominant negative mutant allele.

103. The method of embodiment 95, wherein the dominant negative mutant allele comprises a tissue-specific or tissue-preferred promoter inserted into the gene in reverse orientation as compared to the native promoter of the gene, wherein the tissue-specific or tissue-preferred promoter generates at least one antisense RNA transcript, and wherein expression of the gene is reduced as compared to a control corn plant that lacks the dominant negative mutant allele.

104. The method of embodiment 5, wherein the mutant allele comprises an insertion, an inversion, or a deletion as compared to a wildtype allele of the gene.

105. A method comprising:
- (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_3 locus, wherein the mutant allele comprises a DNA segment inserted into the endogenous GA20 oxidase_3 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_3 locus produces a RNA transcript comprising the antisense RNA sequence; and
- (b) harvesting said hybrid corn seeds from one or more of the female inbred corn plants.

106. A method comprising:
- (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a DNA segment inserted into the endogenous GA20 oxidase_5 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_5 locus produces a RNA transcript comprising the antisense RNA sequence; and
- (b) harvesting said hybrid corn seeds from one or more of the female inbred corn plants.

107. A method comprising:
- (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of an endogenous Brachytic2 (br2) locus, wherein the mutant allele comprises a DNA segment inserted into the endogenous br2 locus, wherein the DNA segment encodes an antisense RNA that is at least 70% complementary to at least 20 consecutive nucleotides of SEQ ID NO: 132 or 180, and wherein the mutant allele of the endogenous br2 locus produces an RNA transcript comprising the antisense RNA sequence; and
- (b) harvesting said hybrid corn seeds from one or more of the female inbred corn plants.

108. A method comprising:
- (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of an endogenous Brachytic2 (br2) locus, wherein the mutant allele comprises a deletion of at least one nucleotide from an endogenous br2 locus as compared to SEQ ID NO: 132; and
- (b) harvesting said hybrid corn seeds from one or more of the female inbred corn plants.

109. A method comprising:
- (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a premature stop codon within a nucleic acid sequence encoding a Brachytic2 protein as compared to a control corn plant; and
- (b) harvesting said hybrid corn seeds from one or more of the female inbred corn plants.

110. A method comprising:
- (a) crossing at least one male inbred corn plant with a plurality of female inbred corn plants to produce hybrid corn seeds, wherein the plurality of female inbred corn plants comprise a short stature phenotype exhibited by an average height that is at least 2.5% lower than the average height of the at least one male inbred corn plant, wherein the plurality of female inbred corn plants comprise a dominant or semi-dominant transgene or mutant allele of a gene, and wherein the transgene or mutant allele causes the short stature phenotype of the plurality of female inbred corn plants; and
- (b) harvesting said hybrid corn seeds from one or more of the female inbred corn plants.

111. The method of any one of embodiments 105-110, wherein the crossing comprises fertilization of said plurality of female inbred corn plants with pollen from said at least one male inbred corn plant.

112. A method comprising:
- (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_3 locus, wherein the mutant allele comprises a DNA segment inserted into the endogenous GA20 oxidase_3 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_3 locus produces a RNA transcript comprising the antisense RNA sequence; and (b) harvesting said hybrid corn seeds from one or more of the female inbred corn plants.

113. A method comprising:

(a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a DNA segment inserted into the endogenous GA20 oxidase_5 locus, wherein the DNA segment encodes an antisense RNA sequence that is at least 70% complementary to at least 20 consecutive nucleotides of one or more of SEQ ID NOs: 182-184 and 186-188, and wherein the mutant allele of the endogenous GA20 oxidase_5 locus produces a RNA transcript comprising the antisense RNA sequence; and (b) harvesting said hybrid corn seeds from one or more of the female inbred corn plants.

114. A method comprising:

(a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of an endogenous Brachytic2 (br2) locus, wherein the mutant allele comprises a DNA segment inserted into the endogenous br2 locus, wherein the DNA segment encodes an antisense RNA that is at least 70% complementary to at least 20 consecutive nucleotides of SEQ ID NO: 132 or 180, and wherein the mutant allele of the endogenous br2 locus produces an RNA transcript comprising the antisense RNA sequence; and (b) harvesting said hybrid corn seeds from one or more of the female inbred corn plants.

115. A method comprising:

(a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of an endogenous Brachytic2 (br2) locus, wherein the mutant allele comprises a deletion of at least one nucleotide from an endogenous br2 locus as compared to SEQ ID NO: 132; and (b) harvesting said hybrid corn seeds from one or more of the female inbred corn plants.

116. A method comprising:

(a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a premature stop codon within a nucleic acid sequence encoding a Brachytic2 protein as compared to a control corn plant; and (b) harvesting said hybrid corn seeds from one or more of the female inbred corn plants.

117. A method comprising:

(a) planting at least one male inbred corn plant in proximity to a plurality of female inbred corn plants to produce hybrid corn seeds, wherein the female inbred corn plants comprise a short stature phenotype exhibited by an average height that is at least 2.5% lower than the average height of the at least one male inbred corn plant, wherein the female inbred corn plants comprise a dominant or semi-dominant transgene or mutant allele of a gene, and wherein the transgene or mutant allele causes the short stature phenotype of the female inbred corn plants; and (b) harvesting said hybrid corn seeds from one or more of the female inbred corn plants.

118. A method comprising:

(a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genome modification comprising a deletion of at least a portion of the transcription termination sequence of the endogenous Zm.SAMT gene, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

119. A method comprising:

(a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genome modification comprising a deletion of at least a portion of the intergenic region between the endogenous GA20 oxidase_5 and Zm.SAMT genes, and wherein the mutant allele produces a RNA molecule comprising an antisense sequence complementary to all or part of the sense strand of the endogenous GA20 oxidase_5 gene; and (b) harvesting said hybrid corn seeds from one or more of the female inbred corn plants.

120. A method comprising:

(a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genome modification comprising a deletion of at least a portion of one or more of the following: 5' UTR, $1^{st}$ exon, $1^{st}$ intron, $2^{nd}$ exon, $2^{nd}$ intron, $3^{rd}$ exon, 3' UTR, and any portion thereof, and the 5' UTR, $1^{st}$ exon, $1^{st}$ intron, $2^{nd}$ exon, $2^{nd}$ intron, $3^{rd}$ exon, $3^{rd}$ intron, $4^{th}$ exon, $4^{th}$ intron, $5^{th}$ exon, $5^{th}$ intron, $6^{th}$ exon, $6^{th}$ intron, $7^{th}$ exon, $7^{th}$ intron, $8^{th}$ exon, 3' UTR, and any portion thereof, of the endogenous Zm.SAMT gene; and (b) harvesting said hybrid corn seeds from one or more of the female inbred corn plants.

121. The method of any one of embodiments 118-120, wherein the mutant allele comprises the endogenous Zm.SAMT gene promoter, or a portion thereof, operably linked to a transcribable DNA sequence encoding a RNA molecule that causes suppression of one or both of the endogenous GA20 oxidase_3 gene and the endogenous GA20 oxidase_5 gene.

122. The method of any one of embodiments 118-120, wherein the mutant allele comprises the endogenous Zm.SAMT gene promoter, or a portion thereof, operably linked to a transcribable DNA sequence encoding a RNA molecule comprising an antisense sequence that is at least 80% complementary to all or part of the endogenous GA20 oxidase_3 or GA20 oxidase_5 gene.

123. The method of embodiment 122, wherein the transcribable DNA sequence is at least 80% complementary to a RNA transcript sequence, or a portion thereof, encoded by the endogenous GA20 oxidase_3 or GA20 oxidase_5 gene.

124. The method of embodiment 122, wherein the transcribable DNA sequence is at least 80% complementary to at least 15 consecutive nucleotides of one or more of SEQ ID NOs: 218-220, 222-224, 226, and 228-255.

125. The method of embodiment 122, wherein the transcribable DNA sequence is at least 80% complementary to at least 15 consecutive nucleotides of one or more of SEQ ID NOs: 222-224 and 228-235.

126. The method of any one of embodiments 118-125, wherein the genome modification further deletes at least a portion of the transcription termination sequence of the endogenous GA20 oxidase_5 gene.

127. The method of any one of embodiments 118-126, wherein the genome modification comprises a deletion of one or both of the transcription termination sequences of the endogenous GA20 oxidase_5 and SAMT genes.

128. The method of any one of embodiments 118-127, wherein the genome modification comprises a deletion of at least 25 consecutive nucleotides of the intergenic region between the endogenous GA20 oxidase_5 and SAMT genes.

129. The method of any one of embodiments 118-128, wherein the genome modification comprises a deletion of the entire intergenic region between the endogenous GA20 oxidase_5 and SAMT genes.

130. The method of any one of embodiments 118-129, wherein the genome modification comprises a deletion of one or more sequence elements selected from the group consisting of the 5' UTR, $1^{st}$ exon, $1^{st}$ intron, $2^{nd}$ exon, $2^{nd}$ intron, $3^{rd}$ exon, 3' UTR, and any portion of the foregoing, of the endogenous GA20 oxidase_5 gene.

131. The method of any one of embodiments 118-130, wherein the genome modification comprises a deletion of one or more sequence elements selected from the group consisting of the 5' UTR, $1^{st}$ exon, $1^{st}$ intron, $2^{nd}$ exon, $2^{nd}$ intron, $3^{rd}$ exon, $3^{rd}$ intron, $4^{th}$ exon, $4^{th}$ intron, $5^{th}$ exon, $5^{th}$ intron, $6^{th}$ exon, $6^{th}$ intron, $7^{th}$ exon, $7^{th}$ intron, $8^{th}$ exon, 3' UTR, and any portion of the foregoing, of the endogenous Zm.SAMT locus.

132. The method of any one of embodiments 118-131, wherein the mutant allele produces a RNA molecule comprising an antisense sequence that is at least 80% complementary to a RNA transcript sequence, or a portion thereof, encoded by the endogenous GA20 oxidase_5 gene.

133. The method of any one of embodiments 118-132, wherein the RNA transcript sequence comprises a sequence that is at least 90% identical to at least 15 consecutive nucleotides of one or more of SEQ ID NOs: 218-220, 222-224, 226, and 228-255.

134. The method of any one of embodiments 118-133, wherein the RNA transcript sequence comprises a sequence that is at least 90 identical to at least 15 consecutive nucleotides of one or more of SEQ ID NOs: 222-224 and 228-235.

135. The method of any one of embodiments 118-134, wherein the antisense sequence of the RNA molecule is at least 80% complementary to at least 15 consecutive nucleotides of one or more of SEQ ID NOs: 218-220, 222-224, 226, and 228-255.

136. The method of any one of embodiments 118-135, wherein the antisense sequence of the RNA molecule is at least 80% complementary to at least 15 consecutive nucleotides of one or more of SEQ ID NOs: 222-224 and 228-235.

137. The method of any one of embodiments 118-136, wherein the genome modification results in the production of an RNA molecule comprising an antisense sequence from a genomic segment of selected from the group consisting of an exon, a portion of an exon, an intron, a portion of an intron, a 5' or 3' untranslated region (UTR), a portion of an UTR, and any combination of the foregoing, of the endogenous GA20 oxidase_5 locus.

138. The method of any one of embodiments 118-137, wherein the antisense sequence can hybridize with an RNA transcript encoded by a wild-type allele of one or both of the endogenous GA20 oxidase_3 gene and the endogenous GA20 oxidase_5 gene.

139. The method of any one of embodiments 118-138, wherein the antisense sequence can hybridize with a sense RNA transcript encoded by an endogenous GA20 oxidase_5 gene.

140. The method of any one of embodiments 118-138, wherein the antisense sequence can hybridize with a sense RNA transcript encoded by the mutant allele of the endogenous GA20 oxidase_5 gene.

141. The method of embodiment 139 or 140, wherein the sense RNA transcript encoded by the mutant allele of the endogenous GA20 oxidase_5 gene is shortened or truncated relative to a wild-type allele of the endogenous GA20 oxidase_5 gene.

142. The method of any one of embodiments 138-141, wherein the hybridization can cause suppression of a wild-type or mutant allele of the endogenous GA20 oxidase_3 gene, a wild-type or mutant allele of the endogenous GA20 oxidase_5 gene, or a wild-type or mutant allele of both genes.

143. The method of any one of embodiments 118-142, wherein the genome modification comprises two or more, three or more, four or more, five or more, or six or more non-contiguous deletions.

144. A method comprising:
(a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genome modification which results in the transcription of an anti sense strand of at least an exon, an intron, or an untranslated region (UTR) of the endogenous GA20 oxidase_5 gene, or any portion thereof; and
(b) harvesting said hybrid corn seeds from one or more of the female inbred corn plants.

145. A method comprising:
(a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises the Zm.SAMT gene promoter, or a functional part thereof, operably linked to at least one transcribable antisense sequence of at least an exon, intron or untranslated region (UTR) of the endogenous GA20 oxidase_5 gene, or any portion thereof; and
(b) harvesting said hybrid corn seeds from one or more of the female inbred corn plants.

146. A method comprising:
(a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a sequence selected from the group consisting of SEQ ID NOs: 304-322; and
(b) harvesting said hybrid corn seeds from one or more of the female inbred corn plants.

147. A method comprising:
(a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a first sequence and a second sequence; wherein the first sequence comprises one or more of the 5' UTR, $1^{st}$ exon, $1^{st}$ intron, $2^{nd}$ exon, $2^{nd}$ intron, $3^{rd}$ exon, 3' UTR, and any complementary sequence thereof, and any portion of the foregoing, of the endogenous Zm.GA20 oxidase_5 gene; and wherein the second sequence comprises one or more of the 5' UTR, $1^{st}$ exon, $1^{st}$ intron, $2^{nd}$ exon, $2^{nd}$ intron, $3^{rd}$ exon, $3^{rd}$ intron, $4^{th}$ exon, $4^{th}$ intron, $5^{th}$ exon, $5^{th}$ intron, $6^{th}$ exon, $6^{th}$ intron, $7^{th}$ exon, $7^{th}$ intron, $8^{th}$ exon, 3' UTR, and any complementary sequence thereof, and any portion of the foregoing, of the endogenous Zm.SAMT gene; wherein the first sequence and the second sequence are contiguous or separated only by an intervening sequence of fewer than 555 nucleotides; and
(b) harvesting said hybrid corn seeds from one or more of the female inbred corn plants.

148. A method comprising:
(a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genomic deletion relative to a wild type allele of the endogenous GA20 oxidase_5 locus, wherein the genomic deletion is flanked by a first sequence and a second sequence; wherein the first sequence comprises one or more of the 5' UTR, $1^{st}$ exon, $1^{st}$ intron, $2^{nd}$ exon, $2^{nd}$ intron, $3^{rd}$ exon, 3' UTR, and any complementary sequence thereof, and any portion of the foregoing, of the endogenous Zm.GA20 oxidase_5 gene; and wherein the second sequence comprises one or more of the 5' UTR, $1^{st}$ exon, $1^{st}$ intron, $2^{nd}$ exon, $2^{nd}$ intron, $3^{rd}{}_{exon}$, $3^{rd}$ intron, $4^{th}$ exon, $4^{th}$ intron, $5^{th}$ exon, $5^{th}$ intron, $6^{th}$ exon, $6^{th}$ intron, $7^{th}$ exon, $7^{th}$ intron, $8^{th}$ exon, 3' UTR, and any complementary sequence thereof, and any portion of the foregoing, of the endogenous Zm.SAMT gene; and
(b) harvesting said hybrid corn seeds from one or more of the female inbred corn plants.

149. A method comprising:
(a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a mutant allele of the endogenous GA20 oxidase_5 locus, wherein the mutant allele comprises a genomic sequence comprising a first sequence and a second sequence; wherein the first sequence comprises at least 15 consecutive nucleotides of one or more of SEQ ID NOs: 228-235 and 276-283; wherein the second sequence comprises at least 15 consecutive nucleotides of one or more of SEQ ID NOs: 235-276; and wherein the genomic sequence is at least 50 consecutive nucleotides in length, and/or fewer than 9000 consecutive nucleotides in length; and
(b) harvesting said hybrid corn seeds from one or more of the female inbred corn plants.

150. The method of any one of embodiments 147-149, wherein the first sequence comprises one or more of SEQ ID NOs: 228-235 and 276-283, or any portion thereof, and wherein the second sequence comprises one or more of SEQ ID NOs: 235-276, or any portion thereof.

151. The method of any one of embodiments 147-149, wherein the first sequence comprises one or more of SEQ ID NOs: 9-18 and 59-66, or any portion thereof, and wherein the second sequence comprises one or more of SEQ ID NOs: 9, 10, 235-276, or any portion thereof
152. The method of any one of embodiments 147-151, wherein the first sequence comprises at least 15 consecutive nucleotides of one or more of SEQ ID NOs: 9-18 and 59-66, and wherein the second sequence comprises at least 15 consecutive nucleotides of one or more of SEQ ID NOs: 9, 10, 235-276.
153. The method of any one of embodiments 148-152, wherein the genomic deletion comprises a deletion of the intergenic region between the endogenous Zm.GA20 oxidase_5 and Zm.SAMT genes.
154. The method of any one of embodiments 149-153, wherein the genomic deletion has a length of at least 250 nucleotides.
155. The method of any one of embodiments 149-154, wherein the genomic deletion has a length of at most 7500 nucleotides.
156. The method of any one of embodiments 149-155, wherein the genomic deletion corresponds to a deletion of one or more genomic regions comprising a sequence selected from the group consisting of SEQ ID NOs. 11-66.
157. The method of any one of embodiments 149-156, wherein the genome deletion results in the production of an RNA transcript comprising an antisense sequence from a genomic segment of the endogenous GA20 oxidase_5 locus selected from the group consisting of an exon, portion of an exon, an intron, portion of an intron, an untranslated region (UTR), portion of an UTR, and any combination of the foregoing.
158. The method of any one of embodiments 144-157, wherein the mutant allele can suppress the expression of a wild-type allele of the endogenous GA20 oxidase_3 locus, a wild-type allele of the endogenous GA20 oxidase_5 locus, or both.
159. The method of any one of embodiments 112-158, wherein the corn plant is homozygous for the mutant allele at the endogenous GA20 oxidase_5 locus.
160. The method of any one of embodiments 112-158, wherein the corn plant is heterozygous for the mutant allele at the endogenous GA20 oxidase_5 locus.
161. The method of any one of embodiments 112-160, wherein the female inbred corn plant(s) has a shorter plant height and/or improved lodging resistance relative to an unmodified control plant.
162. The method of any one of embodiments 112-161, wherein the female inbred corn plant(s) exhibits an at least 2.5% reduction in plant height at maturity relative to an unmodified control plant.
163. The method of any one of embodiments 112-162, wherein the plant height reduction is between 5% and 40%.
164. The method of any one of embodiments 112-163, wherein the stalk or stem diameter of the female inbred corn plant(s) at one or more stem internodes is at least 5% greater than the stalk or stem diameter at the same one or more internodes of an unmodified control plant.
165. The method of any one of embodiments 112-164, wherein the stalk or stem diameter of the female inbred corn plant(s) at one or more of the first, second, third, and/or fourth internode below the ear is at least 5% greater than the same internode of an unmodified control plant.
166. The method of any one of embodiments 112-165, wherein the level of one or more active GAs in at least one internode tissue of the stem or stalk of the female inbred corn plant(s) is at least 5% lower than the same internode tissue of an unmodified control plant.
167. The method of any one of embodiments 112-166, wherein the level of one or more active GAs in at least one internode tissue of the stem or stalk of the female inbred corn plant(s) is lower than the same internode tissue of an unmodified control plant.
168. The method of any one of embodiments 112-167, wherein the female inbred corn plant(s) does not have any significant off-types in at least one female organ or ear.
169. The method of any one of embodiments 112-168, wherein the female inbred corn plant(s) exhibits essentially no reproductive abnormality.
170. A method comprising:
   (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of the transcription termination sequence of the endogenous Zm.SAMT gene, and wherein the mutant allele produces a RNA molecule comprising an antisense sequence complementary to all or part of the sense strand of the endogenous GA20 oxidase_5 gene; and
   (b) harvesting said hybrid corn seeds from one or more of the female inbred corn plants.
171. A method comprising:
   (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of the intergenic region between the endogenous GA20 oxidase_5 and Zm.SAMT genes, and wherein the mutant allele produces a RNA molecule comprising an antisense sequence complementary to all or part of the sense strand of the endogenous GA20 oxidase_5 gene; and
   (b) harvesting said hybrid corn seeds from one or more of the female inbred corn plants.
172. A method comprising:
   (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of one or more of the following: 5' UTR, $1^{st}$ exon, $1^{st}$ intron, $2^{nd}$ exon, $2^{nd}$ intron, $3^{rd}$ exon, 3' UTR, and any portion thereof, and the 5' UTR, $1^{st}$ exon, $1^{st}$ intron, $2^{nd}$ exon, $2^{nd}$ intron, $3^{rd}$ exon, $3^{rd}$ intron, $4^{th}$ exon, $4^{th}$ intron, $5^{th}$ exon, $5^{th}$ intron, $6^{th}$ exon, $6^{th}$ intron, $7^{th}$ exon, $7^{th}$ intron, $8^{th}$ exon, 3' UTR, and any portion thereof, of the endogenous Zm.SAMT gene; and (b) harvesting said hybrid corn seeds from one or more of the female inbred corn plants.

173. A method comprising:

(a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification which results in the transcription of an antisense strand of at least an exon, an intron, or an untranslated region (UTR) of the endogenous GA20 oxidase_5 gene, or any portion thereof; and (b) harvesting said hybrid corn seeds from one or more of the female inbred corn plants.

174. A method comprising:

(a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises the Zm.SAMT gene promoter, or a functional part thereof, operably linked to at least one transcribable antisense sequence of at least an exon, intron or untranslated region (UTR) of the endogenous GA20 oxidase_5 gene, or any portion thereof; and (b) harvesting said hybrid corn seeds from one or more of the female inbred corn plants.

175. A method comprising:

(a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a sequence selected from the group consisting of SEQ ID NOs: 304-322e; and (b) harvesting said hybrid corn seeds from one or more of the female inbred corn plants.

176. A method comprising:

(a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a first sequence and a second sequence; wherein the first sequence comprises one or more of the 5' UTR, $1^{st}$ exon, $1^{st}$ intron, $2^{nd}$ exon, $2^{nd}$ intron, $3^{rd}$ exon, 3' UTR, and any complementary sequence thereof, and any portion of the foregoing, of the endogenous Zm.GA20 oxidase_5 gene; and wherein the second sequence comprises one or more of the 5' UTR, $1^{st}$ exon, $1^{st}$ intron, $2^{nd}$ exon, $2^{nd}$ intron, $3^{rd}$ exon, $3^{rd}$ intron, $4^{th}$ exon, $4^{th}$ intron, $5^{th}$ exon, $5^{th}$ intron, $6^{th}$ exon, $6^{th}$ intron, $7^{th}$ exon, $7^{th}$ intron, $8^{th}$ exon, 3' UTR, and any complementary sequence thereof, and any portion of the foregoing, of the endogenous Zm.SAMT gene; wherein the first sequence and the second sequence are contiguous or separated only by an intervening sequence of fewer than 555 nucleotides; and (b) harvesting said hybrid corn seeds from one or more of the female inbred corn plants.

177. A method comprising:

(a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic deletion relative to a wild type allele of the endogenous GA20 oxidase_5 locus, wherein the genomic deletion is flanked by a first sequence and a second sequence; wherein the first sequence comprises one or more of the 5' UTR, $1^{st}$ exon, $1^{st}$ intron, $2^{nd}$ exon, $2^{nd}$ intron, $3^{rd}$ exon, 3' UTR, and any complementary sequence thereof, and any portion of the foregoing, of the endogenous Zm.GA20 oxidase_5 gene; and wherein the second sequence comprises one or more of the 5' UTR, $1^{st}$ exon, $1^{st}$ intron, $2^{nd}$ exon, $2^{nd}$ intron, $3^{rd}$ exon, $3^{rd}$ intron, $4^{th}$ exon, $4^{th}$ intron, $5^{th}$ exon, $5^{th}$ intron, $6^{th}$ exon, $6^{th}$ intron, $7^{th}$ exon, $7^{th}$ intron, $8^{th}$ exon, 3' UTR, and any complementary sequence thereof, and any portion of the foregoing, of the endogenous Zm.SAMT gene; and (b) harvesting said hybrid corn seeds from one or more of the female inbred corn plants.

178. A method comprising:

(a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic sequence comprising a first sequence and a second sequence; wherein the first sequence comprises at least 15 consecutive nucleotides of one or more of SEQ ID NOs: 228-235 and 276-283; wherein the second sequence comprises at least 15 consecutive nucleotides of one or more of SEQ ID NOs: 235-276; and wherein the genomic sequence is at least 50 consecutive nucleotides in length, and/or fewer than 9000 consecutive nucleotides in length; and (b) harvesting said hybrid corn seeds from one or more of the female inbred corn plants.

179. A method comprising:
(a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of the transcription termination sequence of the endogenous Zm.SAMT gene, and wherein the mutant allele produces a RNA molecule comprising an antisense sequence complementary to all or part of the sense strand of the endogenous GA20 oxidase_5 gene; and
(b) harvesting said hybrid corn seeds from one or more of the female inbred corn plants.

180. A method comprising:
(a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of the intergenic region between the endogenous GA20 oxidase_5 and Zm.SAMT genes, and wherein the mutant allele produces a RNA molecule comprising an antisense sequence complementary to all or part of the sense strand of the endogenous GA20 oxidase_5 gene; and
(b) harvesting said hybrid corn seeds from one or more of the female inbred corn plants.

181. A method comprising:
(a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification comprising a deletion of at least a portion of one or more of the following: 5' UTR, $1^{st}$ exon, $1^{st}$ intron, $2^{nd}$ exon, $2^{nd}$ intron, $3^{rd}$ exon, 3' UTR, and any portion thereof, and the 5' UTR, $1^{st}$ exon, $1^{st}$ intron, $2^{nd}$ exon, $2^{nd}$ intron, $3^{rd}$ exon, $3^{rd}$ intron, $4^{th}$ exon, $4^{th}$ intron, $5^{th}$ exon, $5^{th}$ intron, $6^{th}$ exon, $6^{th}$ intron, $7^{th}$ exon, $7^{th}$ intron, $8^{th}$ exon, 3' UTR, and any portion thereof, of the endogenous Zm.SAMT gene; and
(b) harvesting said hybrid corn seeds from one or more of the female inbred corn plants.

182. A method comprising:
(a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genome modification which results in the transcription of an antisense strand of at least an exon, an intron, or an untranslated region (UTR) of the endogenous GA20 oxidase_5 gene, or any portion thereof; and
(b) harvesting said hybrid corn seeds from one or more of the female inbred corn plants.

183. A method comprising:
(a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises the Zm.SAMT gene promoter, or a functional part thereof, operably linked to at least one transcribable antisense sequence of at least an exon, intron or untranslated region (UTR) of the endogenous GA20 oxidase_5 gene, or any portion thereof; and
(b) harvesting said hybrid corn seeds from one or more of the female inbred corn plants.

184. A method comprising:
(a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a sequence selected from the group consisting of SEQ ID NOs: 304-322; and
(b) harvesting said hybrid corn seeds from one or more of the female inbred corn plants.

185. A method comprising:
(a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic deletion relative to a wild type allele of the endogenous GA20 oxidase_5 locus, wherein the genomic deletion is flanked by a first sequence and a second sequence; wherein the first sequence comprises one or more of the 5' UTR, $1^{st}$ exon, $1^{st}$ intron, $2^{nd}$ exon, $2^{nd}$ intron, $3^{rd}$ exon, 3' UTR, and any complementary sequence thereof, and any portion of the foregoing, of the endogenous Zm.GA20 oxidase_5 gene; and wherein the second sequence comprises one or more of the 5' UTR, $1^{st}$ exon, $1^{st}$ intron, $2^{nd}$ exon, $2^{nd}$ intron, $3^{rd}$ exon, $3^{rd}$ intron, $4^{th}$ exon, $4^{th}$ intron, $5^{th}$ exon, $5^{th}$ intron, $6^{th}$ exon, $6^{th}$ intron, $7^{th}$ exon, $7^{th}$ intron, $8^{th}$ exon, 3' UTR, and any complementary sequence thereof, and any portion of the foregoing, of the endogenous Zm.SAMT gene; and
(b) harvesting said hybrid corn seeds from one or more of the female inbred corn plants.

186. A method comprising:

(a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic deletion relative to a wild type allele of the endogenous GA20 oxidase_5 locus, wherein the genomic deletion is flanked by a first sequence and a second sequence; wherein the first sequence comprises one or more of the 5' UTR, 1st exon, 1st intron, 2nd exon, 2nd intron, 3rd exon, 3' UTR, and any complementary sequence thereof, and any portion of the foregoing, of the endogenous Zm.GA20 oxidase_5 gene; and wherein the second sequence comprises one or more of the 5' UTR, 1st exon, 1st intron, 2nd exon, 2nd intron, 3rd exon, 3rd intron, 4th exon, 4th intron, 5th exon, 5th intron, 6th exon, 6th intron, 7th exon, 7th intron, 8th exon, 3' UTR, and any complementary sequence thereof, and any portion of the foregoing, of the endogenous Zm.SAMT gene; and (b) harvesting said hybrid corn seeds from one or more of the female inbred corn plants.

187. A method comprising:

(a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a mutant allele of the endogenous GA20 oxidase_5 locus, wherein the mutant allele comprises a genomic sequence comprising a first sequence and a second sequence; wherein the first sequence comprises at least 15 consecutive nucleotides of one or more of SEQ ID NOs: 228-235 and 276-283; wherein the second sequence comprises at least 15 consecutive nucleotides of one or more of SEQ ID NOs: 235-276; and wherein the genomic sequence is at least 50 consecutive nucleotides in length, and/or fewer than 9000 consecutive nucleotides in length; and (b) harvesting said hybrid corn seeds from one or more of the female inbred corn plants.

188. The method of any one of embodiments 1-187, wherein the female corn plant does not have any significant off-types in at least one female organ or ear.

189. The method of any one of embodiments 1-5, 118-120, or 144-149, wherein the yield or seed yield of hybrid corn seeds produced in step (b) is greater than the yield or seed yield of control hybrid corn seeds obtained from fertilizing a plurality of control female inbred corn plants with pollen from at least one control male inbred corn plant and harvesting said control hybrid corn seeds from one or more of said control female inbred corn plants, wherein said control hybrid corn seeds are harvested from the same number of female inbred corn plants as in step (b), and wherein the average height of said plurality of control female inbred corn plants is the same or similar to the average height of said at least one control male inbred corn plants.

190. The method of any one of embodiments 1-5, 118-120, or 144-149, wherein said female inbred corn plants have an average height that is at least 5%, at least 10%, at least 15%, at least 20%, at least 25%, at least 30%, at least 35%, at least 40%, at least 45%, at least 50%, at least 55%, at least 60%, or at least 70% shorter than said at least one male inbred corn plant.

191. The method of any one of embodiments 1-5, 118-120, or 144-149, wherein said female inbred corn plants have an average height that is between 2.5% and 50% shorter than said at least one male inbred corn plant.

192. The method of any one of embodiments 1-5, 118-120, or 144-149, wherein said female inbred corn plants comprise one or more ears at least 18 inches, at least 19 inches, at least 20 inches, at least 21 inches, at least 22 inches, at least 23 inches, or at least 24 inches above ground level.

193. The method of any one of embodiments 1-5, 118-120, or 144-149, wherein said female inbred corn plants comprise at least one ear that is at least 18 inches above ground level.

194. The method of embodiment 193, wherein said female inbred corn plants comprise at least one ear that is at least 24 inches above ground level.

195. The method of embodiment 189, wherein the yield and/or seed yield is increased by at least 3.0%, at least 3.5%, at least 4.0%, at least 4.5%, at least 5.0%, at least 5.5%, at least 6.0%, at least 6.5%, at least 7.0%, at least 7.5%, at least 8.0%, at least 8.5%, at least 9.0%, at least 9.5%, at least 10%, at least 11%, at least 12%, at least 13%, at least 14%, at least 15%, at least 16%, at least 17%, at least 18%, at least 19%, or at least 20% relative to the yield of hybrid corn seeds obtained from fertilizing a plurality of control female inbred corn plants with pollen from at least one control male inbred corn plant, wherein the female and male control plants do not differ in average height by more than 5%.

196. The method of embodiment 189, wherein the yield and/or seed yield of said hybrid corn seeds is increased by between 3% and 20% relative to the yield of hybrid corn seeds obtained from fertilizing a plurality of control female inbred corn plants with pollen from at least one control male inbred corn plant, wherein the female and male control plants do not differ in average height by more than 5%.

197. The method of embodiment 189, wherein said female inbred corn plants and said at least one male inbred corn plant are grown in a corn field.

198. The method of embodiment 189, wherein said female inbred corn plants and said at least one male inbred corn plant are grown in a greenhouse.

199. The method of embodiment 189, wherein said female inbred corn plants are detasseled.

200. The method of embodiment 189, wherein said female inbred corn plants have cytoplasmic male sterility.

201. The method of embodiment 189, wherein the heights of said female inbred corn plants and said at least one male inbred corn plant are measured as the distance between the soil and the ligule of the uppermost fully-expanded leaf.

202. The method of embodiment 189, wherein the heights of said female inbred corn plants and said at least one male inbred corn plant are measured as the distance between the soil and the upper leaf surface of the leaf farthest from the soil.

203. The method of embodiment 189, wherein the heights of said female inbred corn plants and said at least one male inbred corn plant are measured as the distance between the soil and the arch of the highest corn leaf that is at least 50% developed.

204. The method of embodiment 189, wherein the heights of said female inbred corn plants and said at least one male inbred corn plant are measured at R1 stage.

205. The method of embodiment 189, wherein the yield is measured in bushels per acre.

206. The method of embodiment 205, wherein the yield is at least 100 bushels per acre, at least 120 bushels per acre, at least 140 bushels per acre, at least 160 bushels per acre, at least 180 bushels per acre, at least 200 bushels per acre, at least 220 bushels per acre, at least 240 bushels per acre, or at least 260 bushels per acre.

207. The method of embodiment 205, wherein the yield is between 100 and 260 bushels per acre.

208. The method of embodiment 189, wherein the seed yield is measured in standard seed units (SSUs) per acre.

209. The method of embodiment 208, wherein the seed yield is at least 80 SSUs per acre, at least 90 SSUs per acre, at least 100 SSUs per acre, at least 110 SSUs per acre, at least 120 SSUs per acre, at least 130 SSUs per acre, at least 140 SSUs per acre, at least 150 SSUs per acre, at least 160 SSUs per acre, at least 170 SSUs per acre, at least 180 SSUs per acre, at least 190 SSUs per acre, or at least 200 SSUs per acre.

210. The method of embodiment 189, wherein the seed yield is measured in average number of kernels per ear.

211. The method of embodiment 210, wherein the seed yield is at least 200 kernels per ear, at least 300 kernels per ear, at least 400 kernels per ear, at least 500 kernels per ear, at least 600 kernels per ear, at least 700 kernels per ear, at least 800 kernels per ear, at least 900 kernels per ear, at least 1,000 kernels per ear, at least 1100 kernels per ear, or at least 1,200 kernels per ear.

212. The method of embodiment 210, wherein the seed yield is between 200 and 1,200 kernels per ear.

213. The method of embodiment 189, wherein the yield is measured in dry weight of kernels.

214. The method of embodiment 213, wherein the yield is at least 0.2 grams per dry kernel, at least 0.25 grams per dry kernel, at least 0.3 grams per dry kernel, at least 0.35 grams per dry kernel, at least 0.4 grams per dry kernel, at least 0.45 grams per dry kernel, at least 0.5 grams per dry kernel, at least 0.55 grams per dry kernel, or at least 0.6 grams per dry kernel.

215. The method of embodiment 213, wherein the yield is between 0.2 and 0.6 grams per dry kernel.

216. The method of embodiment 197, wherein the corn field comprises at least one row of female inbred corn plants and at least one row of male inbred corn plants.

217. The method of embodiment 197, wherein the corn field comprises multiple rows of female inbred corn plants and at least one row of male inbred corn plants.

218. The method of embodiment 197, wherein the corn field comprises multiple rows of female inbred corn plants and multiple rows of male inbred corn plants.

219. The method of embodiment 216, wherein the ratio of female inbred corn plant rows to male inbred corn plant rows is selected from the group consisting of 2:2, 3:2, 4:1, 4:2, 4:3, 6:1, and 6:2.

220. The method of embodiment 216, wherein the corn field comprises between 1 female row and 10 female rows for every male row.

221. The method of embodiment 216, wherein the corn field comprises at least 1, at least 2, at least 3, at least 4, at least 5, at least 6, at least 7, at least 8, at least 9, or at least 10 female rows for every male row.

222. The method of embodiment 197, wherein the corn field further comprises at least two rows of inbred corn plants, and wherein said at least two rows of inbred corn plants are spaced at least 12 inches, at least 14 inches, at least 16 inches, at least 18 inches, at least 20 inches, at least 22 inches, at least 24 inches, at least 26 inches, at least 28 inches, at least 30 inches, at least 32 inches, at least 34 inches, or at least 36 inches apart.

223. The method of embodiment 197, wherein the corn field further comprises at least two rows of inbred corn plants, and wherein said at least two rows are spaced between 12 and 36 inches apart.

224. The method of embodiment 197, wherein the corn field comprises a ratio of at least 1 female inbred corn plant, at least 2 female inbred corn plants, at least 3 female inbred corn plants, at least 4 female inbred corn plants, at least 5 female inbred corn plants, at least 6 female inbred corn plants, at least 7 female inbred corn plants, at least 8 female inbred corn plants, at least 9 female inbred corn plants, at least 10 female inbred corn plants, at least 15 female inbred corn plants, at least 20 female inbred corn plants, at least 25 female inbred corn plants, at least 30 female inbred corn plants, at least 35 female inbred corn plants, at least 40 female inbred corn plants, at least 45 female inbred corn plants, at least 50 female inbred corn plants, at least 60 female inbred corn plants, at least 70 female inbred corn plants, at least 80 female inbred corn plants, at least 90 female inbred corn plants, or at least 100 female inbred corn plants for every male inbred corn plant.

225. The method of embodiment 197, wherein the corn field comprises between 1 female inbred corn plant and 100 female inbred corn plants for every male inbred corn plant.

226. The method of embodiment 197, wherein the corn field comprises a planting density of at least 12,000 corn plants per acre, at least 15,000 corn plants per acre, at least 18,000 corn plants per acre, at least 21,000 corn plants per acre, at least 24,000 corn plants per acre, at least 27,000 corn plants per acre, at least 30,000 corn plants per acre, at least 33,000 corn plants per acre, at least 36,000 corn plants per acre, at least 39,000 corn plants per acre, at least 42,000 corn plants per acre, at least 45,000 corn plants per acre, at least 48,000 corn plants per acre, at least 51,000 corn plants per acre, at least 54,000 corn plants per acre, at least 57,000 corn plants per acre, or at least 60,000 corn plants per acre.

227. The method of embodiment 197, wherein the corn field comprises a planting density of between 12,000 and 60,000 corn plants per acre.

228. The method of embodiment 197, wherein the corn field comprises at least two male inbred corn plants and at least two female inbred corn plants, wherein said female inbred corn plants comprise an average height that is at least 2.5% shorter than the average height of said male inbred corn plants, and wherein said male inbred corn plants exhibit at least 10% less tassel skeletonization as compared to a control corn field comprising at least two control male inbred corn plants and at least two control female inbred corn plants, wherein said male and female control plants have the same or similar plant heights.

229. The method of embodiment 228, wherein tassel skeletonization is measured by the percentage of anthers that undergo dehiscence.
230. The method of embodiment 228, wherein said male inbred corn plants exhibit at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or 100% less tassel skeletonization.
231. The method of any one of embodiments 1-230, wherein the method further comprises (c) selecting at least one hybrid corn seed harvested in step (b), wherein the at least one hybrid corn seed comprises the mutant allele.
232. The method of embodiment 231, wherein step (c) comprises selecting at least one hybrid corn seed that is homozygous or biallelic for the transgene or mutant allele.
233. The method of embodiment 231, wherein step (c) comprises selecting a plurality of corn seeds that are homozygous or biallelic for the transgene or mutant allele.
234. The method of embodiment 231, wherein step (c) comprises selecting at least one hybrid corn seed that is heterozygous or hemizygous for the transgene or mutant allele.
235. The method of embodiment 231, wherein step (c) comprises selecting a plurality of hybrid corn seeds that are heterozygous or hemizygous for the transgene or mutant allele.
236. The method of any one of embodiments 5, 101, or 112, wherein the transgene comprises a recombinant polynucleotide encoding an RNA molecule that suppresses expression of an endogenous GA20 oxidase gene.
237. The method of any one of embodiments 5, 101, or 112, wherein the transgene comprises a recombinant polynucleotide encoding an RNA molecule that suppresses expression of an endogenous GA3 oxidase gene
238. The method of embodiment 231 or 232, wherein the recombinant polynucleotide is operably linked to a promoter.
239. The method of embodiment 231 or 232, wherein the RNA molecule is an antisense RNA molecule.
240. The method of any one of embodiments 1-239, wherein the female corn plant has improved lodging resistance relative to an unmodified control plant.
241. The method of any one of embodiments 1-240, wherein the female corn plant is homozygous for the mutant allele.
242. The method of any one of embodiments 1-240, wherein the female corn plant is heterozygous for the mutant allele.
243. The method of any one of embodiments 1-5, 105-110, 112-117, 118-120, 144-149, or 170-187, wherein the mutant allele is a dominant allele.
244. The method of any one of embodiments 1-5, 105-110, 112-117, 118-120, 144-149, or 170-187, wherein the mutant allele is a semi-dominant allele.
245. A method comprising:
  (a) fertilizing a plurality of female inbred corn plants with pollen from at least one male inbred corn plant to produce hybrid corn seeds, wherein the female inbred corn plants have an average height that is at least 2.5% lower than the average height of the at least one male inbred corn plant, and wherein the female inbred corn plants comprise a recombinant DNA construct comprising a transcribable DNA sequence encoding a GA2 oxidase protein and a plant-expressible promoter, wherein the transcribable DNA sequence is operably linked to the plant-expressible promoter; and
  (b) harvesting said hybrid corn seeds from one or more of the female inbred corn plants.
246. A method comprising:
  (a) crossing at least one male inbred corn plant with a plurality of female inbred corn plants to produce hybrid corn seeds, wherein the plurality of female inbred corn plants have an average height that is at least 2.5% lower than the height or average height of the at least one male inbred corn plant, and wherein the female inbred corn plant comprises a recombinant DNA construct comprising a transcribable DNA sequence encoding a GA2 oxidase protein and a plant-expressible promoter, wherein the transcribable DNA sequence is operably linked to the plant-expressible promoter; and
  (b) harvesting said hybrid corn seeds from one or more of the female inbred corn plants.
247. A method comprising:
  (a) planting at least one male inbred corn plant in proximity to a plurality of female inbred corn plants to produce hybrid corn seeds, wherein the female inbred corn plants have an average height that is at least 2.5% lower than the height or average height of the at least one male inbred corn plant, and wherein the female inbred corn plant comprises a recombinant DNA construct comprising a transcribable DNA sequence encoding a GA2 oxidase protein and a plant-expressible promoter, wherein the transcribable DNA sequence is operably linked to the plant-expressible promoter; and
  (b) harvesting said hybrid corn seeds from one or more of the female inbred corn plants.
248. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 351, 353, 355, 357, 359, 361, 363, 365, 367, and/or 369.
249. The method of any one of embodiments 245-248, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 350, 352, 354, 356, 358, 360, 362, 364, 366, and/or 368.
250. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 371, 373, 375, 377, 379, 381, 383, and/or 385.
251. The method of any one of embodiments 245-247 or 250, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 370, 372, 374, 376, 378, 380, 382, and/or 384.

252. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 387, 389, 391, 393, 395, 397, 399, 401, 403, 405, 407, 409, 411, 413, 415, and/or 417.
253. The method of any one of embodiments 245-247 or 252, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 386, 388, 390, 392, 394, 396, 398, 400, 402, 404, 406, 408, 410, 412, 414, and/or 416.
254. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 419, 421, 423, 425, 427, 429, 431, 433, 435, 437, 439, 441, 443, 445, and/or 447.
255. The method of any one of embodiments 245-247 or 254, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 418, 420, 421, 424, 426, 428, 430, 432, 434, 436, 438, 440, 442, 444, and/or 446.
256. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 449, 451, 453, 455, 457, 459, 461, 463, 465, 467, and/or 469.
257. The method of any one of embodiments 245-247 or 256, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 448, 450, 452, 454, 456, 458, 460, 462, 464, 466, and/or 468.
258. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 471, 473, 475, 477, 479, 481, 483, 485, 487, 489, 491, 493, 495, 497, 499, and/or 501.
259. The method of any one of embodiments 245-247 or 258, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 470, 472, 474, 476, 478, 480, 482, 484, 486, 488, 490, 492, 494, 496, 498, and/or 500.
260. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 503, 505, 507, 509, 511, 513, 515, 517, 519, 521, 523, 525, 527, 529, and/or 531.

261. The method of any one of embodiments 245-247 or 260, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 502, 504, 506, 508, 510, 512, 514, 516, 518, 520, 522, 524, 526, 528, and/or 530.
262. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 533, 535, 537, 539, 541, 543, 545, 547, 549, 551, 553, 555, 557, 559, and/or 561.
263. The method of any one of embodiments 245-247 or 262, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 532, 534, 536, 538, 540, 542, 544, 546, 548, 550, 552, 554, 556, 558, and/or 560.
264. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 563, 565, 567, 569, 571, 573, and/or 575.
265. The method of any one of embodiments 245-247 or 264, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 562, 564, 566, 568, 570, 572, and/or 574.
266. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 577, 579, 581, 583, 585, 587, and/or 589.
267. The method of any one of embodiments 245-247 or 266, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 576, 578, 580, 582, 584, 586, and/or 588.
268. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 591, 593, 595, 597, 599, 601, 603, 605, and/or 607.
269. The method of any one of embodiments 245-247 or 268, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 590, 592, 594, 596, 598, 600, 602, 604, and/or 608.

270. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 609, 611, 613, and/or 615.

271. The method of any one of embodiments 245-247 or 270, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 608, 610, 612, and/or 614.

272. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 617, 619, 621, 623, 625, 627, 629, and/or 631.

273. The method of any one of embodiments 245-247 or 272, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 616, 618, 620, 622, 624, 626, 628, and/or 630.

274. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 633, 635, 637, 639, 641, 643, and/or 645.

275. The method of any one of embodiments 245-247 or 274, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 632, 634, 636, 638, 640, 642, and/or 644.

276. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 647 and/or 649.

277. The method of any one of embodiments 245-247 or 276, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 646 and/or 648.

278. The method of any one of embodiments 245-247, wherein the GA2 oxidase protein is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 651, 653, and/or 655.

279. The method of any one of embodiments 245-247 or 278, wherein the transcribable DNA sequence is, or comprises a sequence that is, at least 80%, at least 85%, at least 90%, at least 95%, at least 96%, at least 97%, at least 98%, at least 99%, at least 99.5%, or 100% identical to one or more of SEQ ID NOs: 650, 652, and/or 654.

280. The method of any one of embodiments 245-279, wherein the plant-expressible promoter is a vascular promoter.

281. The method of embodiment 280, wherein the vascular promoter comprises one of the following: a sucrose synthase promoter, a sucrose transporter promoter, a Sh1 promoter, Commelina yellow mottle virus (CoYMV) promoter, a wheat dwarf geminivirus (WDV) large intergenic region (LIR) promoter, a maize streak geminivirus (MSV) coat protein (CP) promoter, a rice yellow stripe 1 (YS1)-like promoter, or a rice yellow stripe 2 (OsYSL2) promoter.

282. The method of embodiment 280, wherein the vascular promoter comprises a DNA sequence that is at least 80% identical to one or more of SEQ ID NO: 658, SEQ ID NO: 659, SEQ ID NO: 660, SEQ ID NO: 661, or SEQ ID NO: 662, or a functional portion thereof.

283. The method of any one of embodiments 245-279, wherein the plant-expressible promoter is a rice tungro bacilliform virus (RTBV) promoter.

284. The method of embodiment 283, wherein the RTBV promoter comprises a DNA sequence that is at least 80% identical to one or more of SEQ ID NOs: 656 and 657, or a functional portion thereof 285. The method of any one of embodiments 245-279, wherein the plant-expressible promoter is a leaf promoter.

286. The method of embodiment 285, wherein the leaf promoter comprises one or more of the following: a RuBisCO promoter, a PPDK promoter, a FDA promoter, a Nadh-Gogat promoter, a chlorophyll a/b binding protein gene promoter, a phosphoenolpyruvate carboxylase (PEPC) promoter, or a Myb gene promoter.

287. The method of embodiment 285, wherein the leaf promoter comprises a DNA sequence that is at least 80% identical to one or more of SEQ ID NO: 663, SEQ ID NO: 664, or SEQ ID NO: 665, or a functional portion thereof 288. The method of any one of embodiments 245-279, wherein the plant expressible promoter is a constitutive promoter.

289. The method of embodiment 288, wherein the constitutive promoter is selected from the group consisting of: an actin promoter, a CaMV 35S or 19S promoter, a plant ubiquitin promoter, a plant Gos2 promoter, a FMV promoter, a CMV promoter, a MMV promoter, a PCLSV promoter, an Emu promoter, a tubulin promoter, a nopaline synthase promoter, an octopine synthase promoter, a mannopine synthase promoter, or a maize alcohol dehydrogenase, or a functional portion thereof.

290. The method of embodiment 288, wherein the constitutive promoter comprises a DNA sequence that is at least 80% identical to one or more of SEQ ID NOs: 666, SEQ ID NO: 667, SEQ ID NO: 668, SEQ ID NO: 669, SEQ ID NO: 670, SEQ ID NO: 671, SEQ ID NO: 672, SEQ ID NO: 673 or SEQ ID NO: 674, or a functional portion thereof 291. The method of any one of embodiments 245-290, wherein the level of one or more active GAs in at least one internode tissue of the stem or stalk of the modified corn plant is lower than the same internode tissue of an unmodified control plant.

292. The method of any one of embodiments 246 or 248-291, wherein the crossing comprises fertilization of said plurality of female inbred corn plants with pollen from said at least one male inbred corn plant.

293. The method of any one of embodiments 245-292, wherein the female inbred corn plant(s) has a shorter plant height and/or improved lodging resistance relative to an unmodified control plant.

294. The method of any one of embodiments 245-293, wherein the female inbred corn plant(s) exhibits an at least 2.5% reduction in plant height at maturity relative to an unmodified control plant.

295. The method of any one of embodiments 245-294, wherein the plant height reduction is between 5% and 40%.

296. The method of any one of embodiments 245-295, wherein the stalk or stem diameter of the female inbred corn plant(s) at one or more stem internodes is at least 5% greater than the stalk or stem diameter at the same one or more internodes of an unmodified control plant.

297. The method of any one of embodiments 245-296, wherein the stalk or stem diameter of the female inbred corn plant(s) at one or more of the first, second, third, and/or fourth internode below the ear is at least 5% greater than the same internode of an unmodified control plant.

298. The method of any one of embodiments 245-297, wherein the level of one or more active GAs in at least one internode tissue of the stem or stalk of the female inbred corn plant(s) is at least 5% lower than the same internode tissue of an unmodified control plant.

299. The method of any one of embodiments 245-297, wherein the level of one or more active GAs in at least one internode tissue of the stem or stalk of the female inbred corn plant(s) is lower than the same internode tissue of an unmodified control plant.

300. The method of any one of embodiments 245-299, wherein the female inbred corn plant(s) does not have any significant off-types in at least one female organ or ear.

301. The method of any one of embodiments 245-300, wherein the female inbred corn plant(s) exhibits essentially no reproductive abnormality.

302. The method of any one of embodiments 245-301, wherein the yield or seed yield of hybrid corn seeds produced in step (b) is greater than the yield or seed yield of control hybrid corn seeds obtained from fertilizing a plurality of control female inbred corn plants with pollen from at least one control male inbred corn plant and harvesting said control hybrid corn seeds from one or more of said control female inbred corn plants, wherein said control hybrid corn seeds are harvested from the same number of female inbred corn plants as in step (b), and wherein the average height of said plurality of control female inbred corn plants is the same or similar to the average height of said at least one control male inbred corn plants.

303. The method of any one of embodiments 245-302, wherein said female inbred corn plants have an average height that is at least 5%, at least 10%, at least 15%, at least 20%, at least 25%, at least 30%, at least 35%, at least 40%, at least 45%, at least 50%, at least 55%, at least 60%, or at least 70% shorter than said at least one male inbred corn plant.

304. The method of any one of embodiments 245-302, wherein said female inbred corn plants have an average height that is between 2.5% and 50% shorter than said at least one male inbred corn plant.

305. The method of any one of embodiments 245-304, wherein said female inbred corn plants comprise one or more ears at least 18 inches, at least 19 inches, at least 20 inches, at least 21 inches, at least 22 inches, at least 23 inches, or at least 24 inches above ground level.

306. The method of any one of embodiments 245-304, wherein said female inbred corn plants comprise at least one ear that is at least 18 inches above ground level.

307. The method of embodiment 306, wherein said female inbred corn plants comprise at least one ear that is at least 24 inches above ground level.

308. The method of embodiment 302 or 303, wherein the yield and/or seed yield is increased by at least 3.0%, at least 3.5%, at least 4.0%, at least 4.5%, at least 5.0%, at least 5.5%, at least 6.0%, at least 6.5%, at least 7.0%, at least 7.5%, at least 8.0%, at least 8.5%, at least 9.0%, at least 9.5%, at least 10%, at least 11%, at least 12%, at least 13%, at least 14%, at least 15%, at least 16%, at least 17%, at least 18%, at least 19%, or at least 20% relative to the yield of hybrid corn seeds obtained from fertilizing a plurality of control female inbred corn plants with pollen from at least one control male inbred corn plant, wherein the female and male control plants do not differ in average height by more than 5%.

309. The method of embodiment 302 or 303, wherein the yield and/or seed yield of said hybrid corn seeds is increased by between 3% and 20% relative to the yield of hybrid corn seeds obtained from fertilizing a plurality of control female inbred corn plants with pollen from at least one control male inbred corn plant, wherein the female and male control plants do not differ in average height by more than 5%.

310. The method of embodiment 302 or 303, wherein said female inbred corn plants and said at least one male inbred corn plant are grown in a corn field.

311. The method of embodiment 302 or 303, wherein said female inbred corn plants and said at least one male inbred corn plant are grown in a greenhouse.

312. The method of embodiment 302 or 303, wherein said female inbred corn plants are detasseled.

313. The method of embodiment 302 or 303, wherein said female inbred corn plants have cytoplasmic male sterility.

314. The method of embodiment 302 or 303, wherein the heights of said female inbred corn plants and said at least one male inbred corn plant are measured as the distance between the soil and the ligule of the uppermost fully-expanded leaf 315. The method of embodiment 302 or 303, wherein the heights of said female inbred corn plants and said at least one male inbred corn plant are measured as the distance between the soil and the upper leaf surface of the leaf farthest from the soil.

316. The method of embodiment 302 or 303, wherein the heights of said female inbred corn plants and said at least one male inbred corn plant are measured as the distance between the soil and the arch of the highest corn leaf that is at least 50% developed.

317. The method of embodiment 302 or 303, wherein the heights of said female inbred corn plants and said at least one male inbred corn plant are measured at R1 stage.

318. The method of embodiment 302 or 303, wherein the yield is measured in bushels per acre.

319. The method of embodiment 318, wherein the yield is at least 100 bushels per acre, at least 120 bushels per acre, at least 140 bushels per acre, at least 160 bushels per acre, at least 180 bushels per acre, at least 200 bushels per acre, at least 220 bushels per acre, at least 240 bushels per acre, or at least 260 bushels per acre.
320. The method of embodiment 318, wherein the yield is between 100 and 260 bushels per acre.
321. The method of embodiment 302 or 303, wherein the seed yield is measured in standard seed units (SSUs) per acre.
322. The method of embodiment 321, wherein the seed yield is at least 80 SSUs per acre, at least 90 SSUs per acre, at least 100 SSUs per acre, at least 110 SSUs per acre, at least 120 SSUs per acre, at least 130 SSUs per acre, at least 140 SSUs per acre, at least 150 SSUs per acre, at least 160 SSUs per acre, at least 170 SSUs per acre, at least 180 SSUs per acre, at least 190 SSUs per acre, or at least 200 SSUs per acre.
323. The method of embodiment 302 or 303, wherein the seed yield is measured in average number of kernels per ear.
324. The method of embodiment 323, wherein the seed yield is at least 200 kernels per ear, at least 300 kernels per ear, at least 400 kernels per ear, at least 500 kernels per ear, at least 600 kernels per ear, at least 700 kernels per ear, at least 800 kernels per ear, at least 900 kernels per ear, at least 1,000 kernels per ear, at least 1100 kernels per ear, or at least 1,200 kernels per ear.
325. The method of embodiment 323, wherein the seed yield is between 200 and 1,200 kernels per ear.
326. The method of embodiment 302 or 303, wherein the yield is measured in dry weight of kernels.
327. The method of embodiment 326, wherein the yield is at least 0.2 grams per dry kernel, at least 0.25 grams per dry kernel, at least 0.3 grams per dry kernel, at least 0.35 grams per dry kernel, at least 0.4 grams per dry kernel, at least 0.45 grams per dry kernel, at least 0.5 grams per dry kernel, at least 0.55 grams per dry kernel, or at least 0.6 grams per dry kernel.
328. The method of embodiment 326, wherein the yield is between 0.2 and 0.6 grams per dry kernel.
329. The method of embodiment 310, wherein the corn field comprises at least one row of female inbred corn plants and at least one row of male inbred corn plants.
330. The method of embodiment 310, wherein the corn field comprises multiple rows of female inbred corn plants and at least one row of male inbred corn plants.
331. The method of embodiment 310, wherein the corn field comprises multiple rows of female inbred corn plants and multiple rows of male inbred corn plants.
332. The method of embodiment 331, wherein the ratio of female inbred corn plant rows to male inbred corn plant rows is selected from the group consisting of 2:2, 3:2, 4:1, 4:2, 4:3, 6:1, and 6:2.
333. The method of embodiment 331, wherein the corn field comprises between 1 female row and 10 female rows for every male row.
334. The method of embodiment 331, wherein the corn field comprises at least 1, at least 2, at least 3, at least 4, at least 5, at least 6, at least 7, at least 8, at least 9, or at least 10 female rows for every male row.
335. The method of embodiment 310, wherein the corn field further comprises at least two rows of inbred corn plants, and wherein said at least two rows of inbred corn plants are spaced at least 12 inches, at least 14 inches, at least 16 inches, at least 18 inches, at least 20 inches, at least 22 inches, at least 24 inches, at least 26 inches, at least 28 inches, at least 30 inches, at least 32 inches, at least 34 inches, or at least 36 inches apart.
336. The method of embodiment 310, wherein the corn field further comprises at least two rows of inbred corn plants, and wherein said at least two rows are spaced between 12 and 36 inches apart.
337. The method of embodiment 310, wherein the corn field comprises a ratio of at least 1 female inbred corn plant, at least 2 female inbred corn plants, at least 3 female inbred corn plants, at least 4 female inbred corn plants, at least 5 female inbred corn plants, at least 6 female inbred corn plants, at least 7 female inbred corn plants, at least 8 female inbred corn plants, at least 9 female inbred corn plants, at least 10 female inbred corn plants, at least 15 female inbred corn plants, at least 20 female inbred corn plants, at least 25 female inbred corn plants, at least 30 female inbred corn plants, at least 35 female inbred corn plants, at least 40 female inbred corn plants, at least 45 female inbred corn plants, at least 50 female inbred corn plants, at least 60 female inbred corn plants, at least 70 female inbred corn plants, at least 80 female inbred corn plants, at least 90 female inbred corn plants, or at least 100 female inbred corn plants for every male inbred corn plant.
338. The method of embodiment 310, wherein the corn field comprises between 1 female inbred corn plant and 100 female inbred corn plants for every male inbred corn plant.
339. The method of embodiment 310, wherein the corn field comprises a planting density of at least 12,000 corn plants per acre, at least 15,000 corn plants per acre, at least 18,000 corn plants per acre, at least 21,000 corn plants per acre, at least 24,000 corn plants per acre, at least 27,000 corn plants per acre, at least 30,000 corn plants per acre, at least 33,000 corn plants per acre, at least 36,000 corn plants per acre, at least 39,000 corn plants per acre, at least 42,000 corn plants per acre, at least 45,000 corn plants per acre, at least 48,000 corn plants per acre, at least 51,000 corn plants per acre, at least 54,000 corn plants per acre, at least 57,000 corn plants per acre, or at least 60,000 corn plants per acre.
340. The method of embodiment 310, wherein the corn field comprises a planting density of between 12,000 and 60,000 corn plants per acre.
341. The method of embodiment 310, wherein the corn field comprises at least two male inbred corn plants and at least two female inbred corn plants, wherein said female inbred corn plants comprise an average height that is at least 2.5% shorter than the average height of said male inbred corn plants, and wherein said male inbred corn plants exhibit at least 10% less tassel skeletonization as compared to a control corn field comprising at least two control male inbred corn plants and at least two control female inbred corn plants, wherein said male and female control plants have the same or similar plant heights.
342. The method of embodiment 341, wherein tassel skeletonization is measured by the percentage of anthers that undergo dehiscence.
343. The method of embodiment 341, wherein said male inbred corn plants exhibit at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or 100% less tassel skeletonization.

344. The method of any one of embodiments 245-343, wherein the method further comprises (c) selecting at least one hybrid corn seed harvested in step (b), wherein the at least one hybrid corn seed comprises the recombinant DNA construct.

Having described the present disclosure in detail, it will be apparent that modifications, variations, and equivalent aspects are possible without departing from the spirit and scope of the present disclosure as described herein and in the appended claims. Furthermore, it should be appreciated that all examples in the present disclosure are provided as non-limiting examples.

EXAMPLES

Example 1. Comparison of Corn Seed Yield Distribution, as Grouped by Height of Female Parental Line Relative to Male, for Varying Hybrid Combinations To understand the effects on corn seed yield due to the relative height differences of male and female parental inbred lines, over 400 hybrid combinations of varying parental plant heights were studied. The study comprised US hybrid seed production from different parental inbred combinations in diverse growth environments from 2008-2016. Although each of the 400 hybrid combinations may not be equally represented across all testing years and environments, the large data set provides a good indication of yield trends across all female rows in the field in relation to the relative male/female plant heights. Seed yield is defined by Standard Seed Units (SSU) per acre. One SSU for corn is equivalent to 80,000 corn seed kernels.

In this experiment, the yield data (expressed in total SSU's per acre) was separated into two groups: (a) Shorter Female Bucket (where the female parent line comprised a height at least 10% shorter than that of the male line), and (b) Taller Female Bucket (comprising the remainder of the crosses). Three hundred seventy-nine hybrid combinations were grouped into the Taller Female Bucket, and 36 hybrid combinations were grouped in the Shorter Female Bucket. The height difference between each male/female parent pair does not take into account the effect of detasseling the female plants, which was typically done in these fields over this time period. Although the effective female plant height at pollination was shortened after detasseling, the yield data is still meaningful in that relative height differences between female plants should still be present after detasseling.

The seed yield in this analysis (expressed in total SSUs per acre) was measured for each hybrid combination in the study and grouped into the Taller Female or Shorter Female buckets or groups as described above. The distribution of seed yields per acre for the Taller and Shorter Female Buckets is shown in the box and whisker plots in FIG. 1. Each whisker marks the first point outside the box that is larger or smaller than 1.5 times the inner quartile range (IQR), where the IQR is the middle 50% of the data. The 75th percentile and the 25th percentile of the data are marked by the upper and lower ends of the box, respectively, with the median indicated by the dividing line of the box in between the two ends of the box. Most of the data points are expected to fall between the whisker boundaries, although a few additional data points are shown above and below the upper and lower whiskers, respectively.

This data shows that seed yield in the Shorter Female Bucket was less variable than that of the Taller Female Bucket. As shown in FIG. 1, if the female parent line is at least 10% shorter than the pairing male parent line, hybrid seed production stability was significantly improved as demonstrated by a decrease in variation.

Example 2. Distribution of Corn Seed Yield by Height Ratio of Male/Female Parental Lines for Hybrid Combinations of a Single Female Parental Line Corn seed yield is primarily determined by the female parental line in hybrid seed production. To control for variation in genetic potential with corn seed yields, the female parental line in this example was held constant and the male parental lines were varied. The effects of the relative plant heights of the male and female parental lines upon corn seed yield were studied by leveraging the normal variation of plant heights of various male parental lines. Twenty-five different hybrid combinations using various male parental lines for each female line were analyzed in this study.

Figure 2:
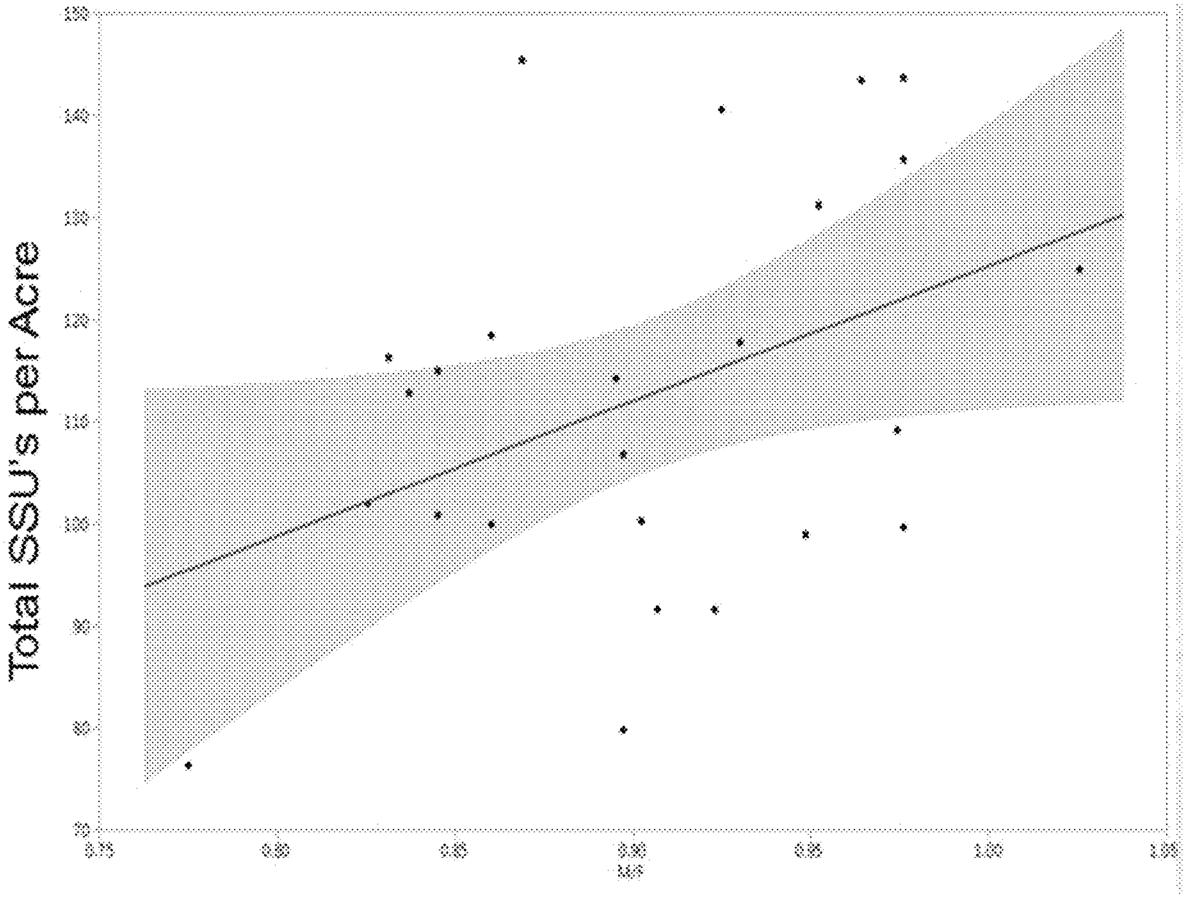
FIG. 2 is a plot comparing male-to-female (M/F) parent corn plant height ratio (x-axis) to hybrid corn seed yield (y-axis, measured in Standard Seed Units (SSUs)) for 25 different hybrid corn combinations.

Although the height difference between each pair of male/female parents does not take into account the effect of detasseling the female plants, which was employed in most of the production practice, the relative plant heights should still be present after detasseling. The seed yield in this analysis (total SSUs per acre) measures the overall seed yield over all female rows. The data presented in FIG. 2 compares corn seed yield, expressed as total SSUs per acre, to the ratio of characteristic heights of male/female parental lines (M/F). Each data point is the average seed yield for each male/female hybrid combination. The linear regression line is shown. The shaded area covers 95% confidence for the regression line.

While seed yield varies significantly for individual male/female hybrid combinations, FIG. 2 shows an overall trend of higher corn seed yield when the female parental line is shorter relative to the male parental line. In this example, seed yield is an average over the field, and does not distinguished between different rows of females, although it is expected that the more interior female rows further away from the male plants would most benefit from the shorter plant height and improved pollen flow as discussed herein.

Example 3. Short Female Parental Lines Allow for Improved Seed Yield and More Efficient Use of Planting Area Approximately 19% of the male inbreds used in commercial corn production today are considered high risk males due to their tendency for tassel skeletonization and/or reduced pollen load relative to other male lines. Indeed, tassel skeletonization (TSK) can cause male inbred corn plants to have a reduced pollen load. TSK is one of the phenotypes that is taken into account during male risk assessment and selection of male lines for commercial seed production. One of the major inducers of TSK can be shading of male plants by neighboring females.

Figure 3:
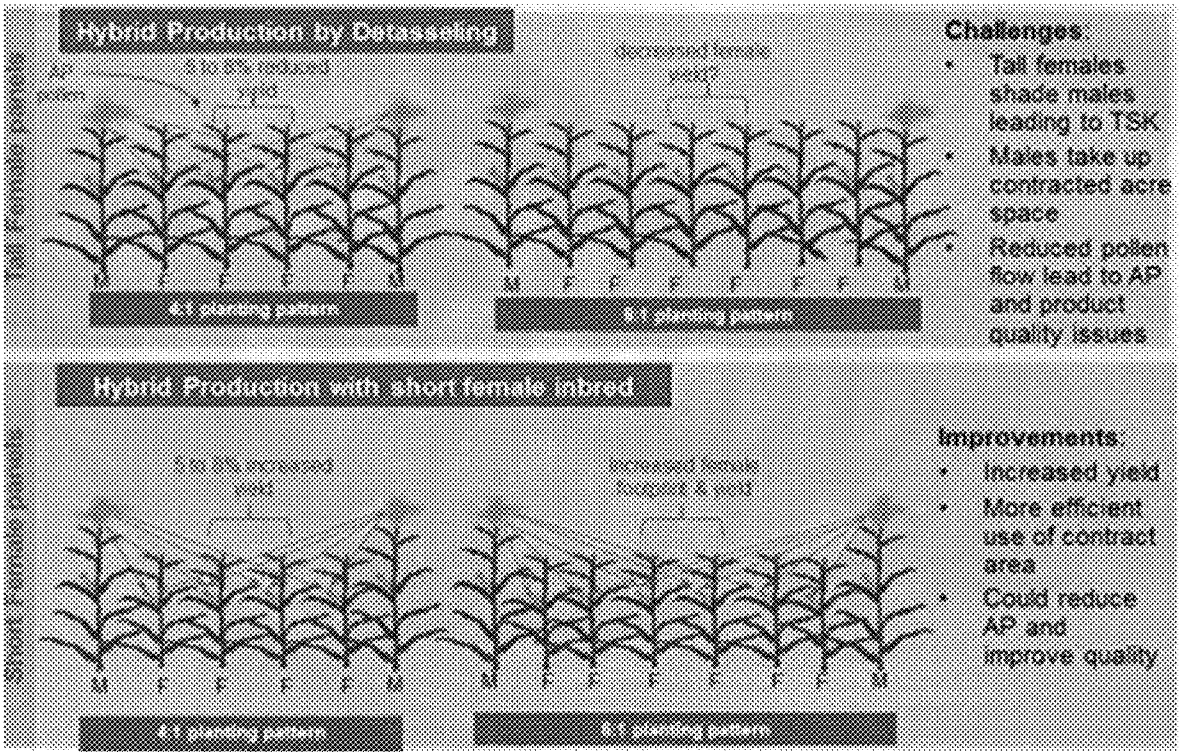
FIG. 3 is a visual representation of two common planting patterns (4:1 and 6:1) incorporating rows of either tall female inbred corn plants (upper panel) or short female inbred plants (lower panel). Abbreviations: TSK: tassel skeletonization; AP: adventitious presence; M: male; F: female.

As introduced above, by reducing the shading of adjacent male plants, shorter female plants reduce the risk of TSK in males and could thereby improve overall seed yield. Historically, the middle two rows in a 4:1 female-to-male row configuration exhibit a 5% to 8% reduction in seed yield relative to the two outer rows due to poor pollen distribution and/or a lack of pollen availability to these rows. In addition to improving yield in the center panels of female rows, shorter female inbred plants could also enable an increase in the ratio of female-to-male rows to 6:1 or some other higher ratio of female-to-male rows than is used currently, which may improve seed yield per acre and/or reduce the overall field production footprint. Having an improved pollen flow with shorter female inbreds can also help ensure that the females are pollinated by the male plants, thus reducing the possibility and/or occurrence rate of adventitious presence (AP) of unwanted transgenes or genetics due to unintended pollination and fertilization events from other pollen sources. A diagram of how shorter female plants can improve pollen flow in a 6:1 and 4:1 arrangement ratio of female-to-male rows is shown in FIG. 3, relative to male and female plants of a similar height.

Example 4. Improved Seed Yield with Short Female Parental Line

Field trials are described in this example demonstrating improved seed yield in hybrid corn seed production by utilizing a shorter female parental line. These corn seed production field trials were conducted over one growing season at two field sites in Illinois, U.S.A., which are approximately 100 miles away from each other, with one of the two sites (first field site) being further north than the other (second) field site. The two sites have similar soil conditions, but the second site received less rainfall than the other (first) site during the trial season.

To produce hybrid corn seeds, a tall inbred male parental line was used with a shorter inbred (transgenic) female parental line. A corresponding tall inbred (non-transgenic) female line was used as a control. The inbred lines were planted with two ratio arrangements of females to males: one with 4:1 female/male row configuration and 30-inch row spacing, and another with 6:1 female/male row configuration and 20-inch row spacing. Each arrangement of female-to-male row ratio had a medium planting density of 34,400 plants/acre for 20-inch row field or 27,200 plants/acre for 30-inch row field, and a high planting density of 39,560 plants/acre for 20-inch row field or 32,000 plants/acres for 30-inch row field. The tall and short female plants were planted with approximately equal spacing along each row. Mature corn ears were hand harvested in these trials, and results were collected from 5 interior plants of each 17.5-inch plot row, with 24 replicates for the 30-inch row spacing plots, and 36 replicates for the 20-inch row spacing plots, respectively. Seed yield was measured as the number of SSUs per acre where the number of acres took into account only the area of female plants. One Standard Seed Unit (SSU) is defined as 80,000 corn seed kernels.

Figure 4:
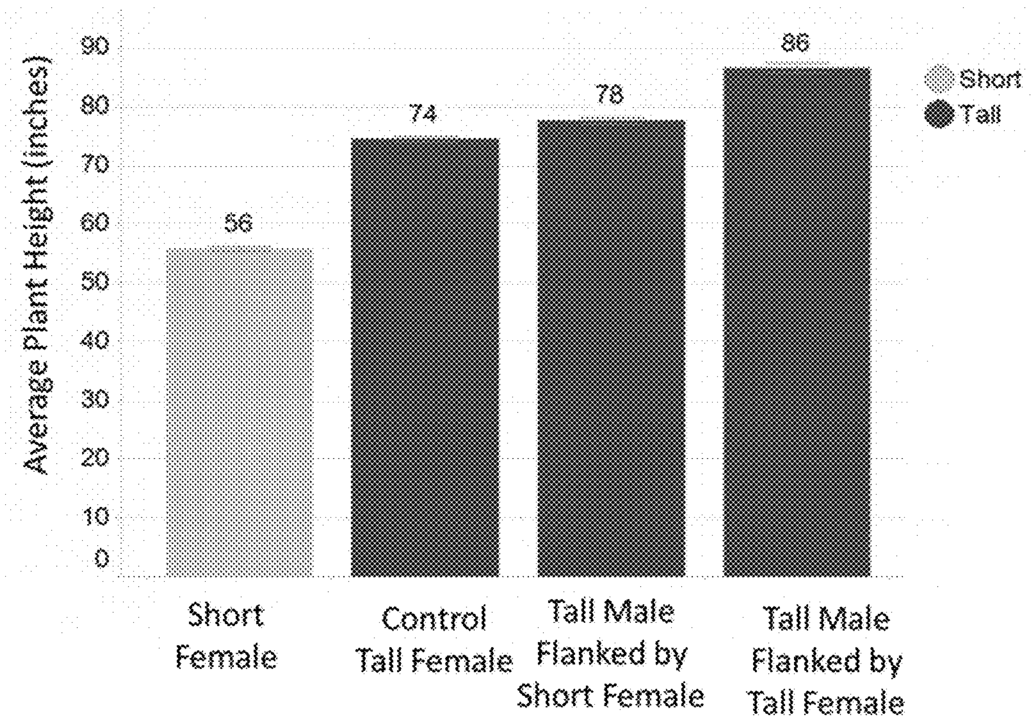
FIG. 4 shows the average plant height (PHT) of the inbred corn plants grown in the present field trials: (1) short female, (2) the control tall female, (3) tall male flanked by short female, and (4) tall male flanked by tall female.

FIG. 4 shows the average plant height (PHT) of the inbred corn plants grown in the present field trials: (1) short female, (2) the control tall female, (3) tall male flanked by short female, and (4) tall male flanked by tall female. In this experiment, the plant height is measured from the ground to the base of the uppermost collared leaf. The vertical error bars indicate the standard errors for PHT. Note that for the same inbred male line, the heights of the male plants flanked by shorter female plants are significantly reduced relative to those flanked by the control tall female plants. Without being bound by theory, the reduced male plant height may result from having less need for competitive vertical growth due to the surrounding female plants being shorter. The reduced vertical growth may improve male corn plant robustness, lodging resistance and stability, as well as male tassel formation and pollen shed.

Figure 5:
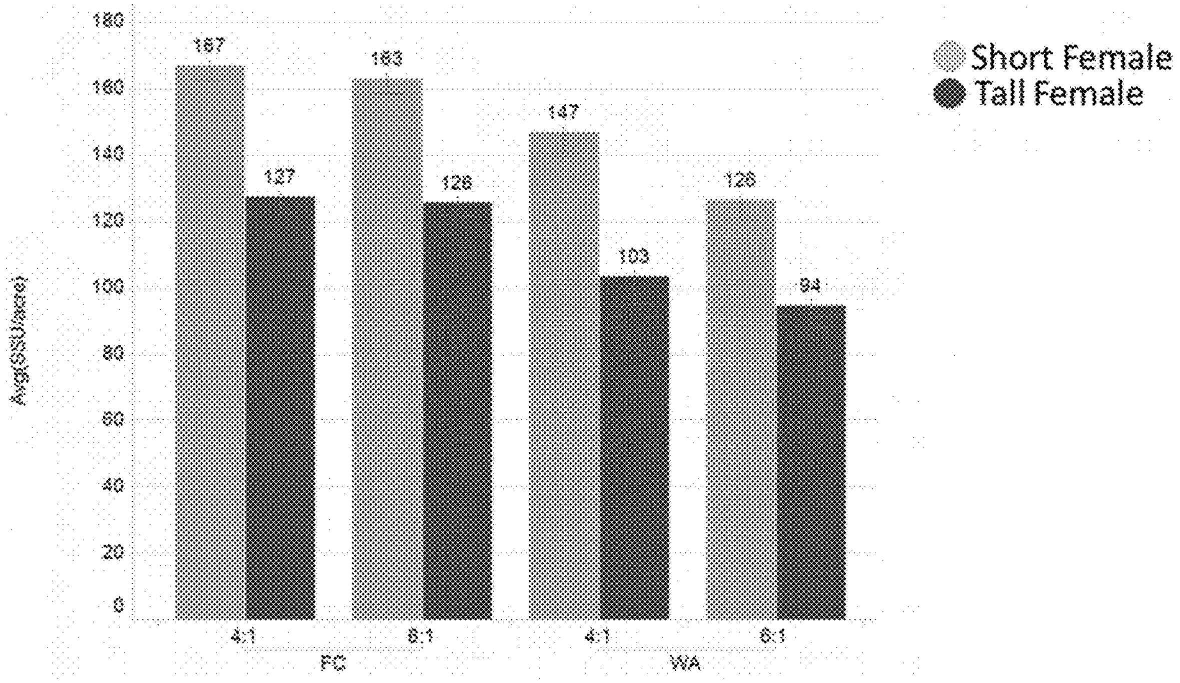
FIG. 5 shows the seed yield in SSU/acre at two testing sites, for both 4:1 and 6:1 female:male row ratio arrangements, averaged over two planting densities.

FIG. 5 shows the seed yield in SSU/acre at the two testing sites, for both 4:1 and 6:1 female:male row ratio arrangements. Seed yield was averaged over the 2 planting densities (described above). In these examples, "WA" is an abbreviation for the first field site, and "FC" is an abbreviation for the second field site. The vertical error bars indicate standard errors for the seed yields. Note the significant improvement in seed yield with shorter female lines, across row planting arrangements at both sites.

Figure 6:
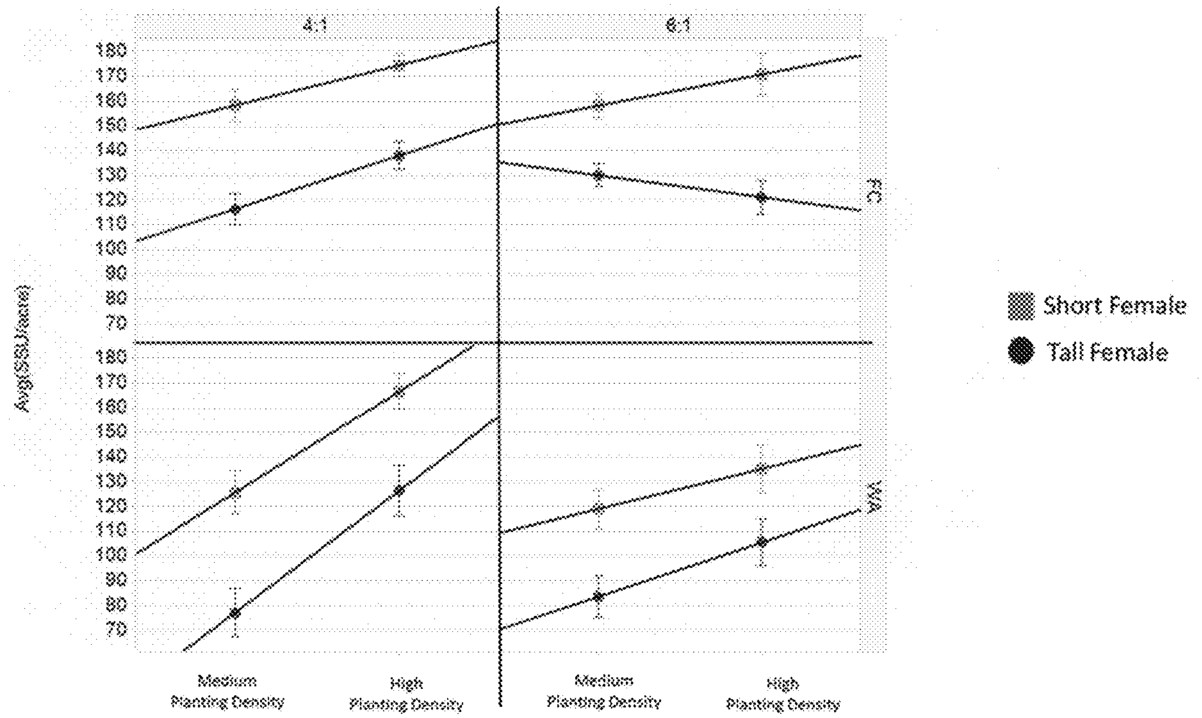
FIG. 6 compares the seed yields of short and tall female lines at two testing sites with 4:1 and 6:1 female-to-male row ratio arrangements, and with two planting densities.

FIG. 6 compares the seed yields of short and tall female lines at two testing sites with 4:1 and 6:1 female-to-male row ratio arrangements, and with two planting densities. "M" indicates medium planting density, and "H" for high planting density. For this experiment, "WA" is an abbreviation for the first site, and "FC" is an abbreviation for the second site. The vertical error bars indicate standard error for the seed yields. Note that the average seed yield is consistently and significantly higher with shorter females than with taller females, at both sites and with both 4:1 and 6:1 female-to-male ratio arrangements of rows, and at both medium and high planting densities. Furthermore, the average seed yield with shorter females is consistently higher at high density relative to medium density planting at both sites and for both of the female-to-male row ratio arrangements.

Example 5. Improved Pollen Production and Distribution with Short Female Parental Line Utilizing short female parental lines in hybrid corn seed production is shown in this example to have direct positive effects on pollen production and dispersion. Without being bound by theory, these positive effects may result from reduced shading of the taller male plants and less physical or wind obstruction to pollen flow from the male tassels by the shorter female plants, resulting in higher seed yields. In this example, direct pollen count measurements are provided over 5 consecutive days of the pollination period, at various female row positions. The "pollination period" is defined as the consecutive five-day period wherein the first day is when the male tassels in the field have reached 10% anthesis. These five consecutive pollination days can be referred to herein as "Day 1", Day 2", etc.

Pollen trap plates of ~5-inch diameter were placed on level platforms positioned adjacent to the female corn plants in different row positions relative to the closest male row at a height similar to the height of the female corn ears. For the 4:1 female-to-male row ratio planting arrangement, the female rows adjacent to male rows are called the "4-1" position, and the two adjacent inner female rows further away from male rows are called the "4-2" position. Likewise, within the 6:1 female-to-male row ratio planting, the "6-1" position includes the female rows adjacent to male rows, the "6-2" position includes the females rows that are two rows away from the closest male rows, and the "6-3" position includes the two adjacent innermost female rows furthest away from male rows.

600 plates were collected daily from each testing site, with 120 plates collected for each of 5 consecutive days of pollination period, of which 48 plates were collected from plots of 30-inch row spacing, and the other 72 plates from 20-inch plots. To count the number of pollen grains collected on each plate, the collected plates were imaged using a commercial multispectral imaging system, with high-resolution images under strobed LED lights of 19 discrete wavelengths from 365 to 970 nm. The images were further combined into a single multispectral image. An image analysis software was developed to count the number of pollen grains for each plate, and to run the subsequent statistical analysis.

The following experiments and accompanying figures show the average daily pollen counts at different row positions based on the placement of the collection plates. These experiments were carried out at both locations with 4:1 or 6:1 female-to-male row arrangements. The measurements were averaged over all plates for a specific day, at one of the two sites, and for a specific female row position and ratio. The vertical error bars indicate standard errors for the average daily pollen counts.

Figure 7:
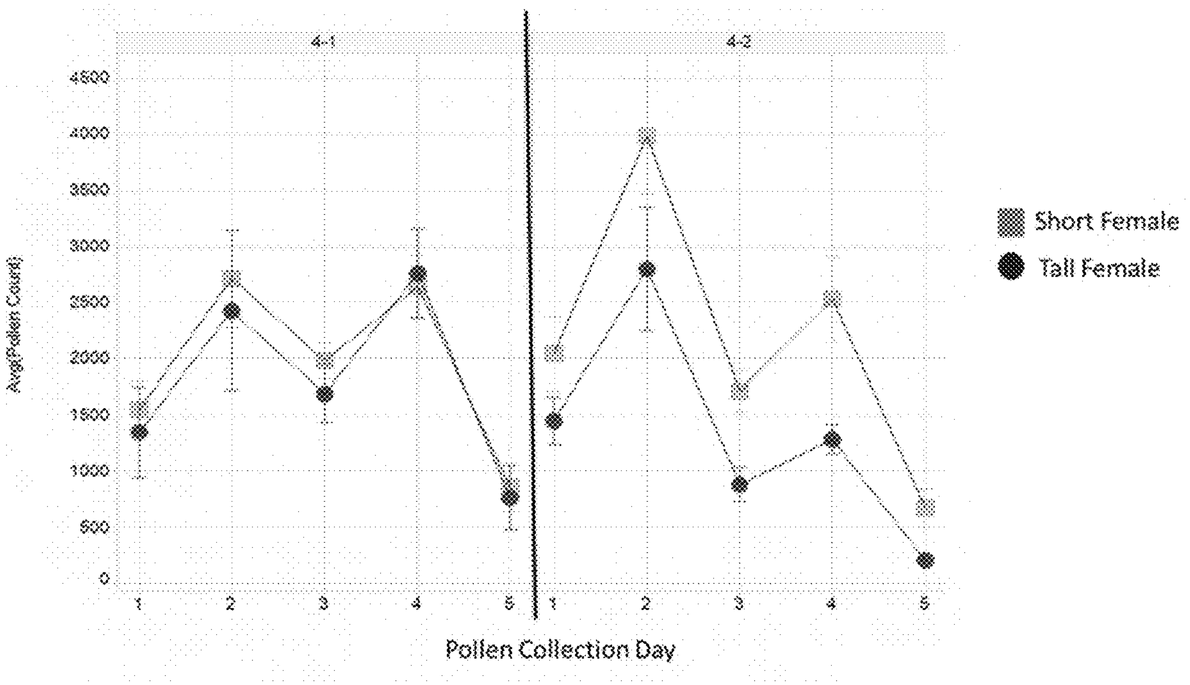
FIG. 7 shows average daily pollen count results for the 4-1 and 4-2 positions at a first field location site with a 4:1 planting arrangement.
Figure 8:
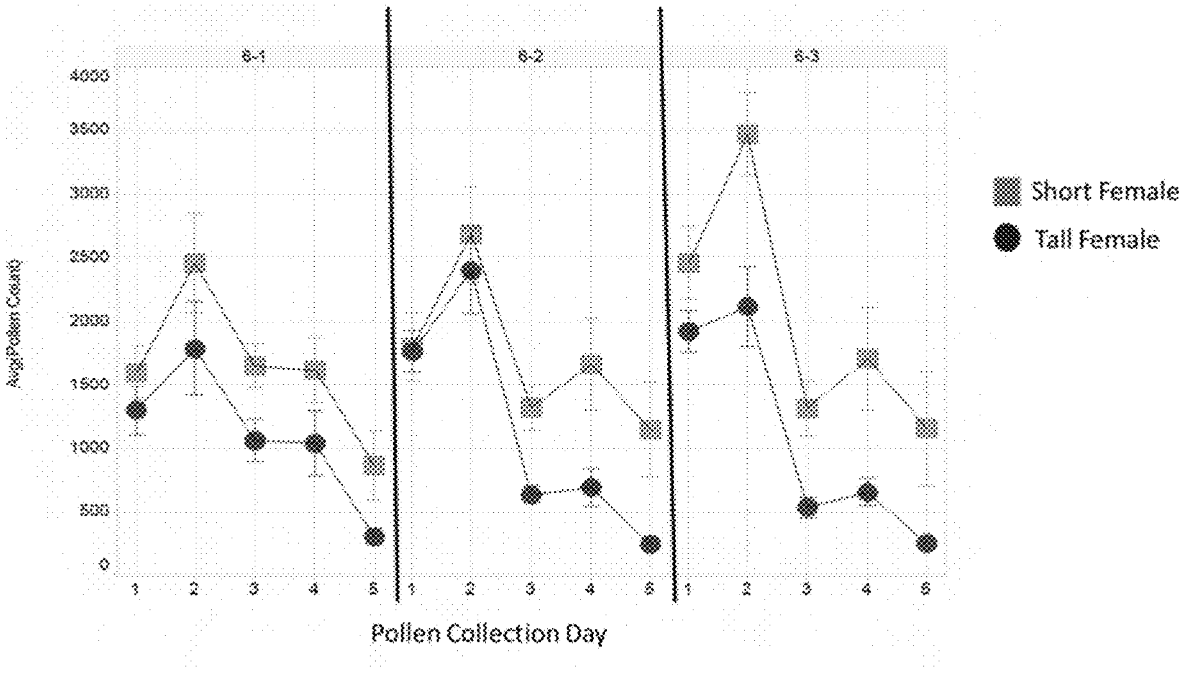
FIG. 8 shows average daily pollen count results for the 6-1, 6-2 and 6-3 positions at a first field location site with a 6:1 planting arrangement.
Figure 9:
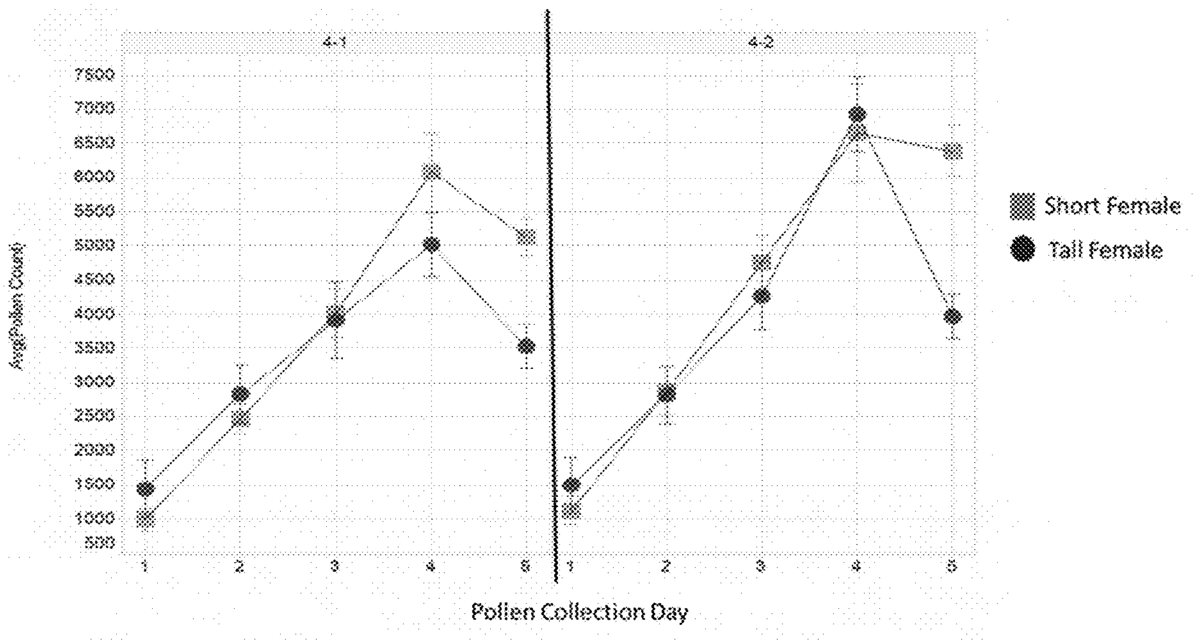
FIG. 9 shows average daily pollen count results for the 4-1 and 4-2 positions at a second field location site with a 4:1 planting arrangement.
Figure 10:
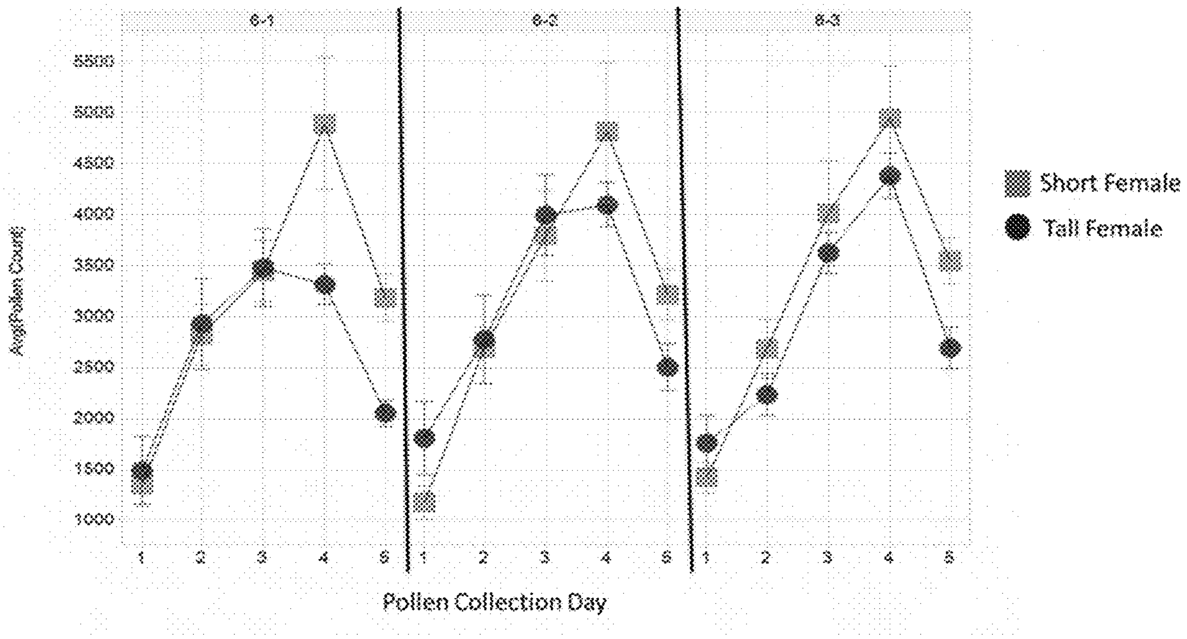
FIG. 10 shows average daily pollen count results for the 6-1, 6-2 and 6-3 positions at a second field location site with a 6:1 planting arrangement.

FIG. 7 shows average daily pollen count results for the 4-1 and 4-2 positions at the first field location site with a 4:1 planting arrangement. In this experiment, position 4-2 showed a significant increase in pollen count with shorter female corn plants, throughout Days 1 to 5. FIG. 8 shows average daily pollen count results for the 6-1, 6-2 and 6-3 positions at the first field location site with a 6:1 planting arrangement. Note the significant increase in pollen count with shorter female corn plants for all positions on Days 3 to 5 and for position 6-3 on Days 1 and 2. FIG. 9 shows average daily pollen count results for the 4-1 and 4-2 positions at the second field location site with a 4:1 planting arrangement. In this experiment, both 4-1 and 4-2 position showed a significant increase in pollen count with shorter female corn plants during Day 5, as well as a significant increase in pollen count with shorter female corn plants at position 4-1 during Day 4. FIG. 10 shows average daily pollen count results for the 6-1, 6-2 and 6-3 positions at the second field location site with a 6:1 planting arrangement. Note the significant increase in pollen count with shorter female corn plants at all row positions (6-1, 6-2 and 6-3) during Day 5 and at row position 6-1 during Day 4. These results show increased pollen collection overall with shorter female plants at both 4:1 and 6:1 female-to-male row ratio planting, with the amounts depending on the ratio of female-to-male rows and the row position.

Without being bound by theory, the increased pollen flow and collection in the rows of shorter female corn plants may at least partially explain and support the increased seed production (SSU/acre) in the production field as shown above.

Example 6. Reduced Male Tassel Skeletonization with Short Female Parental Line Effective pollen production and shedding in hybrid seed production can depend on overall tassel size as well as how fully the tassel develops. In this example, tassel size and development of male inbred plants are observed and measured with either short or tall females. Larger and more developed tassels should produce more pollen leading to greater pollination and seed yields of females. In these experiments, male corn plants next to, or flanked by, shorter female corn plants had larger (data not shown) and more developed tassels with less tassel skeletonization (TSK) (see below), as compared to male corn plants next to, or flanked by, taller female corn plants. Without being bound by theory, it is proposed that the shorter female plants next to the taller male plants permit the male plants to receive more light, perhaps without having to grow as tall, which may improve the development of male reproductive structures.

Tassel skeletonization (TSK), also called "tassel blasting", describes the abortion of glumes and anthers on tassel branches and the main spikelet. It results from an underdevelopment of the tassel and causes reduced pollen production. As known in the art, skeletonization can be measured on the tassels of male parental plants, by a visual rating at 50% pollination stage (P50), on a SKLP scale from 1 to 9, to estimate the level of increasing severity at a plot level. A score of "1" indicates no skeletonization, whereas a score of "9" indicates that the entire tassel is skeletonized. Tassel skeletonization of male corn plants next to either tall or short females was observed and scored according to the above scale. Average SKLP ratings were determined for tassels of male inbred plants flanked in a seed production field by either short female plants (Short) or tall female control plants (Tall) planted at either 20-inch or 30-inch row spacings. For male plants next to taller females, 23 replicates were used for measurement of plants in 30-inch rows, and 26 replicates were used for measurement of plants in 20-inch rows. For male plants next to shorter females, 19 replicates were used for measurement of plants in 30-inch rows, and 26 replicates were used for measurement of plants in 20-inch rows.

Figure 11:
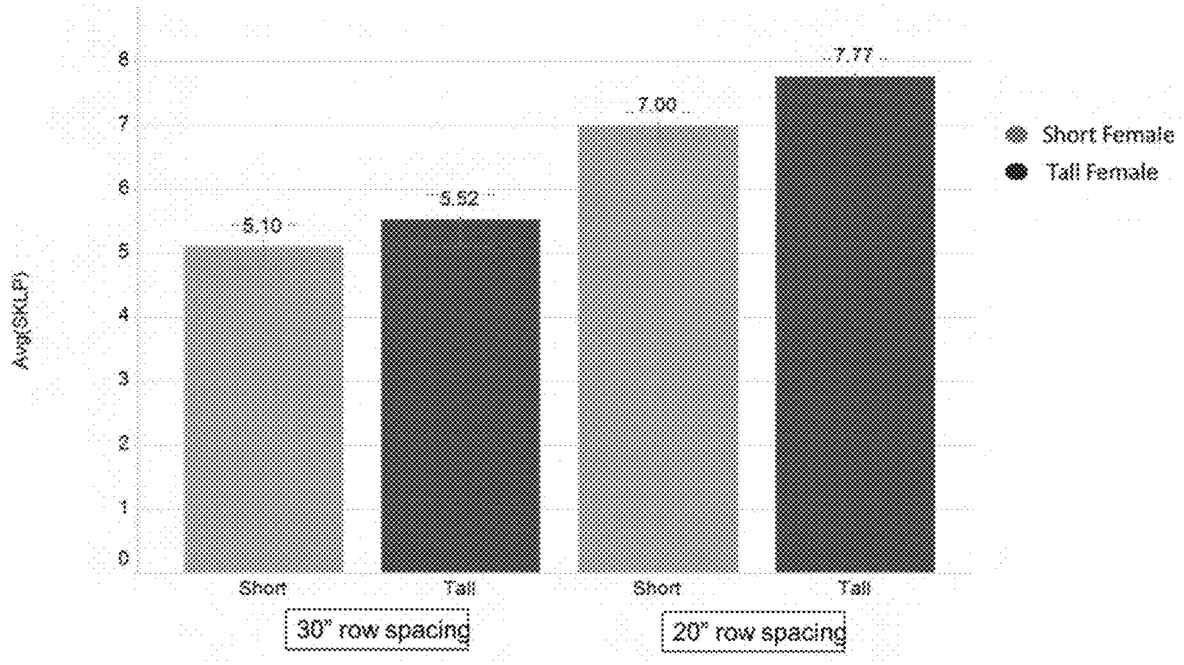
FIG. 11 shows average tassel skeletonization (SKLP) scores of male plants flanked by shorter or taller female plants at 20-inch row spacing and 30-inch row spacing, respectively.

As shown in FIG. 11 for these experiments, male plants flanked by shorter females at 20-inch row spacing had significantly improved (lower) average tassel skeletonization (SKLP) scores (e.g., about 7.0) relative to females planted next to taller females at the same row spacing (e.g., about 7.77). At 30-inch row spacing, average tassel skeletonization (SKLP) scores trended positive toward improvement (e.g., about 5.1), relative to females planted next to taller females at the same row spacing (e.g., 5.52), although the change was not statistically significant. These data indicate that tassel skeletonization of male plants can be reduced with shorter females in corn production fields, which can lead to increased pollen production and shedding.

Without being bound by theory, decreased tassel skeletonization may at least partially explain and support the increased pollen flow and collection in the rows of shorter female corn plants in the production field as shown above.

Example 7. Reduced Plant Lodging with Short Female Parent Line

Corn seed production can be improved if plant lodging is reduced in the production field. It is proposed that the shorter stature female corn plants can have increased lodging resistance relative to taller females, thus leading to improved seed yields in the production field. The shorter stature corn plant may also be more accessible during the growing season with standard height agricultural equipment allowing for over-the-top applications of fertilizer, pesticides, water, etc., to further improve seed yields.

Figure 12:
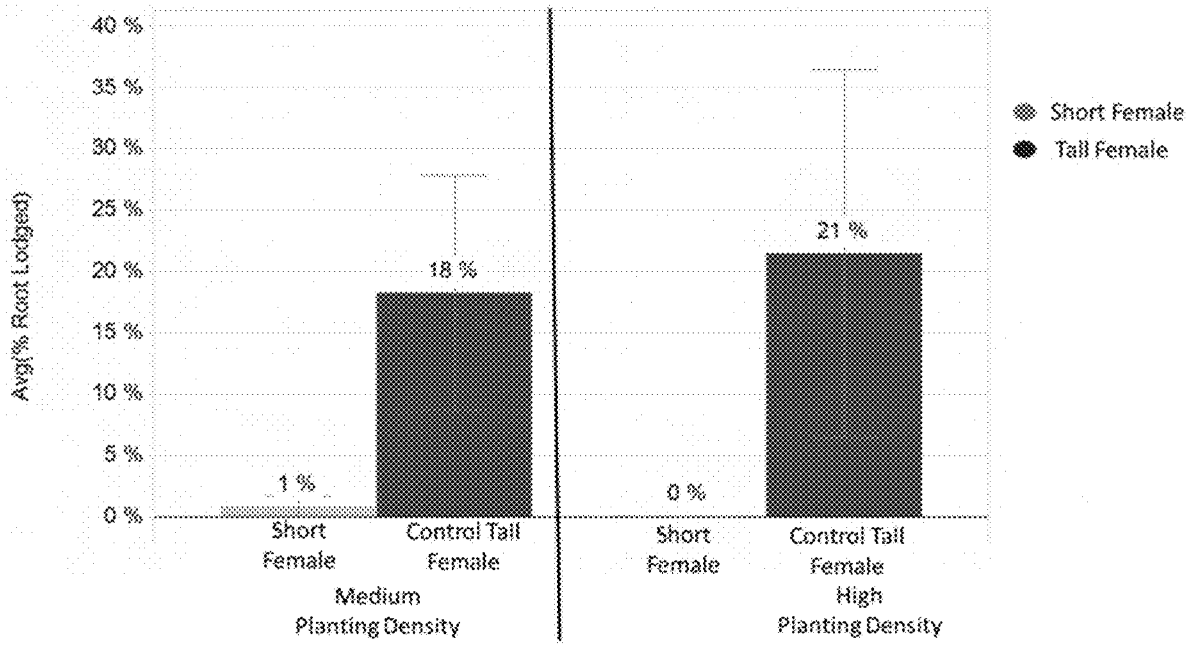
FIG. 12 shows average percentage of root lodged short female plants and root lodged control tall female plants at high and low planting densities.

At one of the corn production field sites, a thunderstorm with high winds caused plant root lodging, particularly among the taller female corn plants in the field. However, the shorter female corn plants exhibited much less lodging at this testing location. Root lodging of female corn plants was measured in a field affected by the storm at both medium (M) and high (H) planting densities. Root lodging data was collected on four female plant rows over the length of the field. A plant was counted as root lodged if it leaned at least 45 degrees from a vertical orientation in the row. 52 replicates were included for both tall and short female corn plants. As shown in FIG. 12, where lodging was significant for the tall control female plants, it was greatly reduced for the short female plants in both medium and high planting density plots. The vertical error bars indicate standard error of average percentage of lodged plants.

Without being bound by theory, the increased lodging resistance of shorter stature female corn plants, in addition to increased pollen flow, may further help to explain and support the increased seed production (SSU/acre) in the production field as shown above.

Having described the present disclosure and inventions in detail, it will be apparent that modifications, variations, and equivalent embodiments are possible without departing from the spirit and scope of the present disclosure as described herein and in the appended claims. Furthermore, it should be appreciated that all examples in the present disclosure are provided as non-limiting examples.

SEQUENCE LISTING (674 sequences)

SEQ ID NO: 1 - DNA, 1741 bp, Zea mays
gacggtagttttcatctaaagtttattcttcgtcacatgggatggccgtttgcttgtttgttgcttccgggaggcggtggtgaattgaagcagatcgacaagcatggctgcccactggtctcgatcgatcggcctgccatgccatgccatgccactagagtccgtcctgactggccgcccgttcccccgtataaaaaggcaggcaggcaggcagagcggggacgagcaagcaagcagttgcagttgcagcggcctcctcctctgcttcctccctcctcctcctcaccatggtgctggctgcgcacgatccccctccccttgtgttcgacgctgcccgcctgagcggcctctccgacatcccgcagcagttcatctggccggcggacgagagccccaccccggactccgccgaggagctggccgtgccgctcatcgacctctccggggacgccgccgaggtggtccggcaggtccggcgcgcctgcgacctgcacggcttcttccaggtggtggggcacggcatcgacgcggcgctgacggcggaggcccaccgctgcatggacgccttcttcacgctgccgctcccggacaagcagcgcgcgcagcgccgccagggggacagctgcggctacgccagcagcttcacgggccggttcgcgtccaagctgccctggaaggagacgctgtcgttccgctacaccgacgacgacgacggcgacaagtccaaggacgtcgtggcgtcctacttcgtggacaagctgggcgaggggtaccggcaccacggggaggtgtacgggcgctactgctctgagatgagccgtctgtcgctggagctcatggaggtgctaggcgagagcctgggcgtgggccggcgccacttccggcgcttcttccaggggaacgactccatcatgcgcctcaactactacccgccgtgccagcggccctacgacacgctgggcacggggccgcattgcgaccccacgtcgctcaccatcctgcaccaggacgacgtgggcggactccaggtgttcgacgccgccacgctcgcgtggcgctccatcaggccccgcccgggcgccttcgtcgtcaacatcggcgacaccttcatggcgctctccaacgggcgctacaggagctgcctccaccgcgccgtcgtcaacagccgggtggcacgccgctcgctcgccttcttcctgtgcccggagatggacaaggtggtcaggccgcccaaggagctggtggacgacgccaacccgagggcgtacccggacttcacgtggaggacgctgctggacttcaccatgaggcactacaggtcggacatgaggacgctcgaggccttctccaactggctcagcaccagtagcaatggcggacagcacctgctggagaagaagtaggcatgctatttgggtatggaagatggtggatgtaagcaaacaaagccaaattaagcagagtaggttaattaaggttggctgatgatccatttagggaaggagctgatctccctgactccctcctccaattttctcaaccaaatttatatagtataataataataataaaatagcaagtaatagttgtatcgtattattattaattaatttattagctggtaggcaagtagtattaaataccatttgtagtacgatgggcgtatttctattttggcgttttgctctgtgttttttgacgtttcctttggatttggggggacctcagatcagctcggcct

SEQ ID NO: 2 - DNA, 1116 bp, Zea mays
atggtgctggctgcgcacgatccccctccccttgtgttcgacgctgcccgcctgagcggcctctccgacatcccgcagcagttcatctggccggcggacgagagccccaccccggactccgccgaggagctggccgtgccgctcatcgacctctccggggacgccgccgaggtggtccggcaggtccggcgcgcctgcgacctgcacggcttcttccaggtggtggggcacggcatcgacgcggcgctgacggcggaggcccaccgctgcatggacgccttcttcacgctgccgctcccggacaagcagcgcgcgcagcgccgccagggggacagctgcggctacgccagcagcttcacgggccggttcgcgtccaagctgccctggaaggagacgctgtcgttccgctacaccgacgacgacgacggcgacaagtccaaggacgtcgtggcgtcctacttcgtggacaagctgggcgaggggtaccggcaccacggggaggtgtacgggcgctactgctctgagatgagccgtctgtcgctggagctcatggaggtgctaggcgagagcctgggcgtgggccggcgccacttccggcgcttcttccaggggaacgactccatcatgcgcctcaactactacccgccgtgccagcggccctacgacacgctgggcacggggccgcattgcgaccccacgtcgctcaccatcctgcaccaggacgacgtgggcggactccaggtgttcgacgccgccacgctcgcgtggcgctccatcaggccccgcccgggcgccttcgtcgtcaacatcggcgacaccttcatggcgctctccaacgggcgctacaggagctgcctccaccgcgccgtcgtcaacagccgggtggcacgccgctcgctcgccttcttcctgtgcccggagatggacaaggtggtcaggccgcccaaggagctggtggacgacgccaacccgagggcgtacccggacttcacgtggaggacgctgctggacttcaccatgaggcactacaggtcggacatgaggacgctcgaggccttctccaactggctcagcaccagtagcaatggcggacagcacctgctggagaagaagtag

SEQ ID NO: 3 - protein, 371 aa, Zea mays
MVLAAHDPPPLVFDAARLSGLSDIPQQFIWPADESPTPDSAEELAVPLIDLSGDAAEVVRQVRRACDLHGFFQVVGHGIDAALTAEAHRCMDAFFTLPLPDKQRAQRRQGDSCGYASSFTGRFASKLPWKETLSFRYTDDDDGDKSKDVVASYFVDKLGEGYRHHGEVYGRYCSEMSRLSLELMEVLGESLGVGRRHFRRFFQGNDSIMRLNYYPPCQRPYDTLGTGPHCDPTSLTILHQDDVGGLQVFDAATLAWRSIRPRPGAFVVNIGDTFMALSNGRYRSCLHRAVVNSRVARRSLAFFLCPEMDKVVRPPKELVDDANPRAYPDFTWRTLLDFTMRHYRSDMRTLEAFSNWLSTSSNGGQHLLEKK

SEQ ID NO: 4 - DNA, 1517 bp, Zea mays
caggaataaaataagcctccgcccggcttcgttgcatccacgcacgcagcaagcgatcggatttcgccagcatggcggcggcggccgtggtgttcgacgccgaggcgctgagccgggaggagcacatcccggcgcagttcgtgtggcccaccgaggagcgggcgccggcgggcggcgtggaggaggtcgccatccccgtggtcgacctcggcgagttcctccgccgcggggtgctcccgcgcggcgtggcggaggcgtgcgagcgccacggcgtcttccaggtggtgaaccacggcgtgggcgccgcgctgctcgccgaggcctaccgctgttgcgacgccttttacgcgctcccgctcgcggacaagcagcgcgcgcagcgccggcacggggagaaccacggctacgccagcagcttcacgggccgcttccactgctgcctgccgtggaaggagacgctgtccttcaactgccccgccggtgccgggactgcgcgcgccgtcgtcggctacttcgtcgacgtcctcggcgaggactaccgccacatgggggaggtgtaccaggagtactgcgacgcgatgacgcgtctggcgctggacgtgacggaggtgctggcggcagcgctggggctggaccgcggcgcactgcgcggcttcttcgagggcggcgactccgtcatgcggctgaaccactacccggcgtgccggcagccgcacctgacgctggggacgggcccgcaccgggacccgacgtcgctgacgctgctgcaccaggacgacgtgggcgggctgcaggtgcgcgccggcggcgggccgtggcgcgcggtgcggccccgcgcggacgcgttcgtggtcaacattggcgacaccttcgccgcgctcaccgacgggcgtcacaccagctgcctgcaccgcgccgtggtgaccggcggcggctcccgccggtcgctcgccttcttcctcaacccgccgctggaccgcgtcgtccgcccgccgggcgcgctcctccaggagaacaagcaggcgggccgcccgcgcgcgttcccggacttcacgtggcgcgagttcctcgagttcacgcagaagcactaccggtcggacgcgggcaccatggacgccttcgtgtcgtggatcgcgggaggccgccgccaccatggcggacaggaggagggcaactgagatcgatgcatctctagctgtaggcagcagcgcagcagctaccaagaataatggccggcgacggagatgcagctacgacgcacaaataaattgagtgtttgtggtacaataaggacgaggacgatcaatggcgacctgtaaccggtgcagttttagttaatctttcatggcgatatggcattaaccaatcgttggtgtaaaatgcgtgcatgctttgcatgccaatgttggccatgtgatggcacagcgtgagtgtagctcacccaccgtgacaacgtgctaatttcgtgtggtcctagataccaaggtcgtctaatgaacttgatggattgatgattt

SEQ ID NO: 5 - DNA, 1107 bp, Zea mays
atggcggcggcggccgtggtgttcgacgccgaggcgctgagccgggaggagcacatcccggcgcagttcgtgtggcccaccgaggagcgggcgccggcgggcggcgtggaggaggtcgccatccccgtggtcgacctcggcgagttcctccgccgcggggtgctcccgcgcggcgtggcggaggcgtgcgagcgccacggcgtcttccaggtggtgaaccacggcgtgggcgccgcgctgctcgccgaggcctaccgctgttgcgacgccttttacgcgctcccgctcgcggacaagcagcgcgcgcagcgccggcacggggagaaccacggctacgccagcagcttcacgggccgcttccactgctgcctgccgtggaaggagacgctgtccttcaactgccccgccggtgccgggactgcgcgcgccgtcgtcggctacttcgtcgacgtcctcggcgaggactaccgccacatgggggaggtgtaccaggagtactgcgacgcgatgacgcgtctggcgctggacgtgacggaggtgctggcggcagcgctggggctggaccgcggcgcactgcgcggcttcttcgagggcggcgactccgtcatgcggctgaaccactacccggcgtgccggcagccgcacctgacgctggggacgggcccgcaccgggacccgacgtcgctgacgctgctgcaccaggacgacgtgggcgggctgcaggtgcgcgccggcggcgggccgtggcgcgcggtgcggccccgcgcggacgcgttcgtggtcaacattggcgacaccttcgccgcgctcaccgacgggcgtcacaccagctgcctgcaccgcgccgtggtgaccggcggcggctcccgccggtcgctcgccttcttcctcaacccgccgctggaccgcgtcgtccgcccgccgggcgcgctcctccaggagaacaagcaggcgggccgcccgcgcgcgttcccggacttcacgtggcgcgagttcctcgagttcacgcagaagcactaccggtcggacgcgggcaccatggacgccttcgtgtcgtggatcgcgggaggccgccgccaccatggcggacaggaggagggcaactga

SEQ ID NO: 6 - protein, 368 aa, Zea mays
MAAAAVVFDAEALSREEHIPAQFVWPTEERAPAGGVEEVAIPVVDLGEFLRRGVLPRGVAEACERHGVFQVVNHGVGAALLAEAYRCCDAFYALPLADKQRAQRRHGENHGYASSFTGRFHCCLPWKETLSFNCPAGAGTARAVVGYFVDVLGEDYRHMGEVYQEYCDAMTRLALDVTEVLAAALGLDRGALRGFFEGGDSVMRLNHYPACRQPHLTLGTGPHRDPTSLTLLHQDDVGGLQVRAGGGPWRAVRPRADAFVVNIGDTFAALTDGRHTSCLHRAVVTGGGSRRSLAFFLNPPLDRVVRPPGALLQENKQAGRPRAFPDFTWREFLEFTQKHYRSDAGTMDAFVSWIAGGRRHHGGQEEGN

SEQ ID NO: 7 - DNA, 1522 bp, Zea mays
gcacactcgcagctcgcacatctcatggtgtcctaagaacggcaagagccagctctgcctagcagcagcgcacagccacatccatggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcaccggcaccctcggccaagatttcgagccagtggggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctaacgagccggccgtctctttcgccggggcccgcgcggggttcgcccacgtggtgatcaggtggcagacatgtggcccacgggccccgcgccgccttccccatttttggacgaccctactgctactactactagtgtacatatgcaaaaaaatacatatatatataggtactttctctaatatttttatatataagcaaggcggcctggtgttcttttctttgttttgtcgacaactgtttgatcccatcctatggacgatggatagttcaatgtttgtac

SEQ ID NO: 8 - DNA, 1161 bp, Zea mays
atggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcaccggcaccctcggccaagatttcgagccagtggggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctaa

SEQ ID NO: 9 - protein, 386 aa, Zea mays
MDASPTPPLPLRAPTPSIDLPAGKDRADAAANKAAAVFDLRREPKIPEPFLWPHEEARPTSAAELEVPVVDVGVLRNGDGAGLRRAAAQVAAACATHGFFQVCGHGVDAALGRAALDGASDFFRLPLAEKQRARRVPGTVSGYTSAHADRFASKLPWKETLSFGFHDGAAAPVVVDYFTGTLGQDFEPVGRVYQRYCEEMKELSLTIMELLELSLGVERGYYREFFEDSRSIMRCNYYPPCPVPERTLGTGPHCDPTALTILLQDDVGGLEVLVDGEWRPVRPVPGAMVINIGDTFMALSNGRYKSCLHRAVVNRRQERQSLAFFLCPREDRVVRPPASAAPRQYPDFTWADLMRFTQRHYRADTRTLDAFTRWLSHGPAAAAPCT

SEQ ID NO: 10 - DNA, 1457 bp, Zea mays
taatcacctcatcacaggtccccccagcctcactctcgcgccggctcaaggtacattgcgtgtcctagccaagacacgcagctcatctcagcctcacacgcacagcaagagcgaggcgtgattcgccatgggcggcctcactatggaccaggccttcgtgcaggcccccgagcaccgccccaagcccatcgtcaccgaggccaccggcatccctctcatcgacctctcgcctctggccgccagcggcggcgccgtggacgcgctggccgccgaggtgggcgcggcgagccgggactggggcttcttcgtggtcgtgggccacggcgtgcccgcagagaccgtggcgcgcgcgacggaggcgcagcgagcgttcttcgcgctgccggcagagcggaaggccgccgtgcggaggaacgaggcggagccgctcgggtactacgagtcggagcacaccaagaacgtgagggactggaaggaggtgtacgacctcgtgccgcgcgagccgccgccgccggcagccgtggccgacggcgagcttgtgttcgataacaagtggccccaggatctaccgggcttcagagaggcgctggaggagtacgcgaaagcgatggaagagctggcgttcaagctgctggagctgatcgcccggagcctgaagctgaggcccgaccggctgcacggcttcttcaaggaccagacgaccttcatccggctgaaccactaccctccttgcccgagccccgacctggccctcggcgtggggcggcacaaggacgccggcgccctgaccatcctgtaccaggacgacgtcggggggctcgacgtccggcggcgctccgacggcgagtgggtccgcgtcaggcccgtgcccgactcgttcatcatcaacgtcggcgacctcatccaggtacgagagcgcggagcaccgggtgtcggtgaactcggcgagggagaggttctccatgccctacttcttcaacccggcgacctacaccatggtggagccggtggaggagctggtgagcaaggacgatccgcccaggtacgacgcctacaactggggcgacttcttcagcaccaggaagaacagcaacttcaagaagctcaacgtggagaacattcagatcgcgcatttcaagaagagcctcgtcctcgcctaactactgctactgctaggatccatgccattgccatgtcgtcttcagattcagagcacgccatgtcgtcgctagcttcgtggtagaacaaataatgatgtgcgtgctgtgtgtaagcatggatatggatgtgaatatgtaatatgatgagcactcctactttggtatgtttgggaataacagacttgtgttggtctggttcattatttgtaagaaaatcaaaaagagttagtagggcaggaggctaaccacagtcatgctgcaccacatccctggtggaaagctggccgggttacgcta

SEQ ID NO: 11 - DNA, 1116 bp, Zea mays
atgggcggcctcactatggaccaggccttcgtgcaggcccccgagcaccgccccaagcccatcgtcaccgaggccaccggcatccctctcatcgacctctcgcctctggccgccagcggcggcgccgtggacgcgctggccgccgaggtgggcgcggcgagccgggactggggcttcttcgtggtcgtgggccacggcgtgcccgcagagaccgtggcgcgcgcgacggaggcgcagcgagcgttcttcgcgctgccggcagagcggaaggccgccgtgcggaggaacgaggcggagccgctcgggtactacgagtcggagcacaccaagaacgtgagggactggaaggaggtgtacgacctcgtgccgcgcgagccgccgccgccggcagccgtggccgacggcgagcttgtgttcgataacaagtggccccaggatctaccgggcttcagagaggcgctggaggagtacgcgaaagcgatggaagagctggcgttcaagctgctggagctgatcgcccggagcctgaagctgaggcccgaccggctgcacggcttcttcaaggaccagacgaccttcatccggctgaaccactaccctccttgcccgagccccgacctggccctcggcgtggggcggcacaaggacgccggcgccctgaccatcctgtaccaggacgacgtcggggggctcgacgtccggcggcgctccgacggcgagtgggtccgcgtcaggcccgtgcccgactcgttcatcatcaacgtcggcgacctcatccaggtacgagagcgcggagcaccgggtgtcggtgaactcggcgagggagaggttctccatgccctacttcttcaacccggcgacctacaccatggtggagccggtggaggagctggtgagcaaggacgatccgcccaggtacgacgcctacaactggggcgacttcttcagcaccaggaagaacagcaacttcaagaagctcaacgtggagaacattcagatcgcgcatttcaagaagagcctcgtcctcgcctaactactgctactgctaggatccatgccattgccatgtcgtcttcagattcagagcacgccatgtcgtcgctagcttcgtggtag

SEQ ID NO: 12 - protein, 371 aa, Zea mays
MGGLTMDQAFVQAPEHRPKPIVTEATGIPLIDLSPLAASGGAVDALAAEVGAASRDWGFFVVVGHGVPAETVARATEAQRAFFALPAERKAAVRRNEAEPLGYYESEHTKNVRDWKEVYDLVPREPPPPAAVADGELVFDNKWPQDLPGFREALEEYAKAMEELAFKLLELIARSLKLRPDRLHGFFKDQTTFIRLNHYPPCPSPDLALGVGRHKDAGALTILYQDDVGGLDVRRRSDGEWVRVRPVPDSFIINVGDLIQVRERGAPGVGELGEGEVLHALLLQPGDLHHGGAGGGAGEQGRSAQVRRLQLGRLLQHQEEQQLQEAQRGEHSDRAFQEEPRPRLTTATARIHAIAMSSSDSEHAMSSLASW

SEQ ID NO: 13 - DNA, 1733 bp, Zea mays
atgaggccgcgcctccctccaaatgttccctccctgccttcgtctttgtcgttgctcgcaaactccctgtcctcccctgttacaaatacccccacccgcccggacagcttccctgcatacttgcagctcgcacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcggctaccacgacggcgccgcgtcgcctgtcgtcgtggactacttcgtcggcaccctcggccaggatttcgagccaatggggtgggtgtaccagaggtactgcgaggagatgaaggagctgtcgctgacgatcatggagctgctggagctgagcctgggcgtggagctgcgcggctactaccgggagttcttcgaggacagccggtccatcatgcggtgcaactactacccgccgtgcccggagccggagcgcacgctgggcacgggcccgcactgcgaccccacggcgctcaccatcctcctgcaggacgacgtgggcgggctggaggtgctggtggacggtgagtggcgccccgtccggcccgtcccgggcgccatggtcatcaacatcggcgacaccttcatggcgctgtcgaacgggaggtacaagagctgcctgcaccgcgcggtggtgaaccagcggcgggcgcggcggtcgctggccttcttcctgtgcccgcgcgaggaccgggtggtgcgcccgccggccagtgctgcgccgcggcgctacccggacttcacctgggccgacctcatgcgcttcacgcagcgccactaccgcgccgacacccgcacgctggacgccttcacccgctggctctcccacggcccggcccaggcggcggcgcctccctgcacctagcgagccgggccaaggccgtctctttcgccccacgtgcgcgcccagctgggcaggtggccagacacgcggcccgcgggccccgcgccgccttgccattttttgacgctggccctactgctgtgctactagtgtacatatgcaagagtacatatatatatatatatatacgtattttctatatattatatataaaagcaaggcggcccggtgcccttctcttgttttgtccacaactgtttgatcccattattctatggaccatggatacttcaatgtttgtactaagaccgtgaacgtgggattcttttccttcctctgtgttttttctgagaaaaattaaa

SEQ ID NO: 14 - DNA, 1392 bp, Zea mays
atgaggccgcgcctccctccaaatgttccctccctgccttcgtctttgtcgttgctcgcaaactccctgtcctcccctgttacaaatacccccacccgcccggacagcttccctgcatacttgcagctcgcacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcggctaccacgacggcgccgcgtcgcctgtcgtcgtggactacttcgtcggcaccctcggccaggatttcgagccaatggggtgggtgtaccagaggtactgcgaggagatgaaggagctgtcgctgacgatcatggagctgctggagctgagcctgggcgtggagctgcgcggctactaccgggagttcttcgaggacagccggtccatcatgcggtgcaactactacccgccgtgcccggagccggagcgcacgctgggcacgggcccgcactgcgaccccacggcgctcaccatcctcctgcaggacgacgtgggcgggctggaggtgctggtggacggtgagtggcgccccgtccggcccgtcccgggcgccatggtcatcaacatcggcgacaccttcatggcgctgtcgaacgggaggtacaagagctgcctgcaccgcgcggtggtgaaccagcggcgggcgcggcggtcgctggccttcttcctgtgcccgcgcgaggaccgggtggtgcgcccgccggccagtgctgcgccgcggcgctacccggacttcacctgggccgacctcatgcgcttcacgcagcgccactaccgcgccgacacccgcacgctggacgccttcacccgctggctctcccacggcccggcccaggcggcggcgcctccctgcacctag

SEQ ID NO: 15 - protein, 463 aa, Zea mays
MRPRLPPNVPSLPSSLSLLANSLSSPVTNTPTRPDSFPAYLQLAHLMVSQERQEPAVPSSSSSSAKRAATSMDASPAPPLLLRAPTPSPSIDLPAGKDKADAAASKAGAAVFDLRREPKIPAPFLWPQEEARPSSAAELEVPMVDVGVLRNGDRAGLRRAAAQVAAACATHGFFQVCGHGVDAALGRAALDGASDFFRLPLAEKQRARRVPGTVSGYTSAHADRFAAKLPWKETLSFGYHDGAASPVVVDYFVGTLGQDFEPMGWVYQRYCEEMKELSLTIMELLELSLGVELRGYYREFFEDSRSIMRCNYYPPCPEPERTLGTGPHCDPTALTILLQDDVGGLEVLVDGEWRPVRPVPGAMVINIGDTFMALSNGRYKSCLHRAVVNQRRARRSLAFFLCPREDRVVRPPASAAPRRYPDFTWADLMRFTQRHYRADTRTLDAFTRWLSHGPAQAAAPPCT

SEQ ID NO: 16 - DNA, 1510 bp, Zea mays
aaagagcgcgcgacggcggcccctgggagagccatgcgagactggaggcggaaccgcgcacgacaccaagctgccgcgccggactgctgcacgcaagcgcagcgcaggaccgaccgacctccgtaggcacgcacggcgccggcggcatggcggagcacctcctgtcgacggccgtgcacgacacgctgccggggagctacgtgcggccggagccggagcgcccgcgcctcgcggaggtcgtgaccggcgcgcgcatccccgtcgtggacctgggcagccccgaccgcggcgcggtcgtggccgccgtcggcgacgcctgccgctcgcacggcttcttccaggtcgtcaaccacgggatacacgccgccctggtcgcggcggtgatggccgcggggcgcggcttcttccggctgccccccgaggagaaggccaagctctactccgacgaccccgccaggaagatccggctgtccaccagcttcaacgtgcgcaaggagacggtgcacaactggcgcgactacctccgcctgcactgccatcccctcgacgagttcctgcccgattggccgtccaacccgcccgatttcaaggagaccatgggcacctactgcaaggaggtccgggagctcgggttcaggctgtacgccgcgatctcggagagcctgggcctagaggcgagctacatgaaggaagcgctgggggagcaggagcagcacatggcggtcaacttctacccgccgtgcccggagccggagctcacctacggcctcccggcgcacaccgaccccaacgcgctcaccatcctgctcatggacccggacgtcgccggcctgcaggtgctccacgccggccagtgggtcgccgtcaacccgcagcccggcgcgctcatcatcaacatcggcgaccagctgcaggcgctgagcaacgggcagtaccggagcgtgtggcaccgcgcggtggtgaactcggaccgggagcgcatgtccgtggcgtcgttcctgtgcccgtgcaaccacgtcgtgctcggccccgcgcggaagctcgtcaccgaggacaccccggccgtgtacaggaactacacgtacgacaagtactacgccaagttctggagcaggaacctggaccaggagcactgcctcgagctcttcagaacctagcgaatcggatacggatggatggatacattacatacgcgccctctgtttttctccatgacgttagaagaacacgttctgcaatgtttgtccattcaaggtggtatcaatcaaggctgtggtcgttgcaattcttccgctccatatacatgattaaatgctttgaaagaaaaagaaaaaaaagaaacacaagtattatggcactactagtgtttttaggaacaaggaaagaggggttgcccctgctggctatatatattaaatataaataaaggtaaggctgtagacattggtgaataagagaaagtatttgagtttctctattgtcactccagaacagactcctttgcctcgat

SEQ ID NO: 17 - DNA, 1011 bp, Zea mays
atggcggagcacctcctgtcgacggccgtgcacgacacgctgccggggagctacgtgcggccggagccggagcgcccgcgcctcgcggaggtcgtgaccggcgcgcgcatccccgtcgtggacctgggcagccccgaccgcggcgcggtcgtggccgccgtcggcgacgcctgccgctcgcacggcttcttccaggtcgtcaaccacgggatacacgccgccctggtcgcggcggtgatggccgcggggcgcggcttcttccggctgccccccgaggagaaggccaagctctactccgacgaccccgccaggaagatccggctgtccaccagcttcaacgtgcgcaaggagacggtgcacaactggcgcgactacctccgcctgcactgccatcccctcgacgagttcctgcccgattggccgtccaacccgcccgatttcaaggagaccatgggcacctactgcaaggaggtccgggagctcgggttcaggctgtacgccgcgatctcggagagcctgggcctagaggcgagctacatgaaggaagcgctgggggagcaggagcagcacatggcggtcaacttctacccgccgtgcccggagccggagctcacctacggcctcccggcgcacaccgaccccaacgcgctcaccatcctgctcatggacccggacgtcgccggcctgcaggtgctccacgccggccagtgggtcgccgtcaacccgcagcccggcgcgctcatcatcaacatcggcgaccagctgcaggcgctgagcaacgggcagtaccggagcgtgtggcaccgcgcggtggtgaactcggaccgggagcgcatgtccgtggcgtcgttcctgtgcccgtgcaaccacgtcgtgctcggccccgcgcggaagctcgtcaccgaggacaccccggccgtgtacaggaactacacgtacgacaagtactacgccaagttctggagcaggaacctggaccaggagcactgcctcgagctcttcagaacctag

SEQ ID NO: 18 - protein, 336 aa, Zea mays
MAEHLLSTAVHDTLPGSYVRPEPERPRLAEVVTGARIPVVDLGSPDRGAVVAAVGDACRSHGFFQVVNHGIHAALVAAVMAAGRGFFRLPPEEKAKLYSDDPARKIRLSTSFNVRKETVHNWRDYLRLHCHPLDEFLPDWPSNPPDFKETMGTYCKEVRELGFRLYAAISESLGLEASYMKEALGEQEQHMAVNFYPPCPEPELTYGLPAHTDPNALTILLMDPDVAGLQVLHAGQWVAVNPQPGALIINIGDQLQALSNGQYRSVWHRAVVNSDRERMSVASFLCPCNHVVLGPARKLVTEDTPAVYRNYTYDKYYAKFWSRNLDQEHCLELFRT

SEQ ID NO: 19 - DNA, 1387 bp, Zea mays
gttttctttttgaacgtaactgacagaagctatctgcctagctacggcgtgtcggttgcttgtctcaccaaagcagcgacatggaagcctgacagctcgtcgcgtcgcgccatttccacccaacaaagcggcggcgccagcacgcactgcttctgcttgtgcgtgctcctccgttccgggcacgcctctaaagtctatacagcctcgaatccatcccggccgccgctcctgggggatactacagcgagccgaagcggggatggcggagatccctgtgatcgacctgcgcgtcgccggctcggcggccgaggagtccgcgcggctgcgggccgcgtgcgagcgcctgggctgcttccgggtgaccggccacggcgtgccctcggtgctcctggcagagatgaaggccgccgtgcgcgcgctcttcgacctccccgacgacgccaagcgccgcaacgccgacgtcatcaccggcagcggctacgtcgcccccagcccgaccaacccgctctacgaggccttcgggctcctcgacgccgccgtgcccaccgacgtcgacgccttttgcgcgctcctcgacgcgccgcccaacatcagggagaccgtcaaggcctacgcggagaagatgcacgatgtgatcgttggcgtcgcccgcgagctggcgtctagcctggggctagtcgaggagcactcgttccaggactggccgtgccagttccgcatcaacaggtacaactacacgcgggagacggtgggctcctccggcgtgcagacccacacggactcgggcttcctcaccgtgctccatgaggacgagtgtgtcggcggcctcgaggtcctggacccgggcaccggcgagttcgtgcccgtggaccccgtcgcgggctcctttctcgtaaacatcggcgacgtcggcacggcgtggagcaacgggaggctgcacaacgtgaagcaccgggtgcggtgcgtcgcacccgtgccgcgcatctccatcgccatgttcctgctcgcacccaaggacgacagcgtgagcgcaccggcggcgttcgtggacgcggaccacccgcgcaggtacaaggtgttcaactacaacgactatcggaggctcagactgtccaccggcgagcacgcaggcgaggcgctcgcacggatggcggcgtgacgtggctggagctgcaaattggattggaagccgagacaagccgttagttatttaccatgcccgtgcgttcaccgcacacaatcatattcaaaagccataaaataaaaaataattttaatatcagtcaacatatggtttaaatatcatatggagtacaatattccgaatttttttttgtaatttagtctgtcttttgaaaaaaatgcacatctagacctccggatgact

SEQ ID NO: 20 - DNA, 900 bp, Zea mays
atggcggagatccctgtgatcgacctgcgcgtcgccggctcggcggccgaggagtccgcgcggctgcgggccgcgtgcgagcgcctgggctgcttccgggtgaccggccacggcgtgccctcggtgctcctggcagagatgaaggccgccgtgcgcgcgctcttcgacctccccgacgacgccaagcgccgcaacgccgacgtcatcaccggcagcggctacgtcgcccccagcccgaccaacccgctctacgaggccttcgggctcctcgacgccgccgtgcccaccgacgtcgacgccttttgcgcgctcctcgacgcgccgcccaacatcagggagaccgtcaaggcctacgcggagaagatgcacgatgtgatcgttggcgtcgcccgcgagctggcgtctagcctggggctagtcgaggagcactcgttccaggactggccgtgccagttccgcatcaacaggtacaactacacgcgggagacggtgggctcctccggcgtgcagacccacacggactcgggcttcctcaccgtgctccatgaggacgagtgtgtcggcggcctcgaggtcctggacccgggcaccggcgagttcgtgcccgtggaccccgtcgcgggctcctttctcgtaaacatcggcgacgtcggcacggcgtggagcaacgggaggctgcacaacgtgaagcaccgggtgcggtgcgtcgcacccgtgccgcgcatctccatcgccatgttcctgctcgcacccaaggacgacagcgtgagcgcaccggcggcgttcgtggacgcggaccacccgcgcaggtacaaggtgttcaactacaacgactatcggaggctcagactgtccaccggcgagcacgcaggcgaggcgctcgcacggatggcggcgtga

SEQ ID NO: 21 - protein, 299 aa, Zea mays
MAEIPVIDLRVAGSAAEESARLRAACERLGCFRVTGHGVPSVLLAEMKAAVRALFDLPDDAKRRNADVITGSGYVAPSPTNPLYEAFGLLDAAVPTDVDAFCALLDAPPNIRETVKAYAEKMHDVIVGVARELASSLGLVEEHSFQDWPCQFRINRYNYTRETVGSSGVQTHTDSGFLTVLHEDECVGGLEVLDPGTGEFVPVDPVAGSFLVNIGDVGTAWSNGRLHNVKHRVRCVAPVPRISIAMFLLAPKDDSVSAPAAFVDADHPRRYKVFNYNDYRRLRLSTGEHAGEALARMAA

SEQ ID NO: 22 - DNA, 1496 bp, Zea mays
gtcggtctcttgtctcaccaaaccggcgacatggtacatggaggccagcccgtcgcttggcgccacaagtctcggtgccgtccgtccgacaagcggcgccagcgcacgctggctgctcgtgcacgcctctaaatacggccccggacccgccaccaagcgaaggccaatcccgtccgccgccccccaccaaccacgaaccacgcaagcgaacccggccggcgcggggcagcggcgatggcggagatcccggtgatcgacctgcgcctcgccggctcgtcgcccgacgagtcggcgcggctgcgcgacgcgtgcgagcgcctgggctgctttcgggtgaccggccacggcgcgcccgcggggctcctggccgacatgaaggccgccgtgcgcgcgctcttcgacctccccgacgacgccaagcgccgcaacgccgacgtcatccccggcagcggctacgtcgcgccctgccccgccaacccgctctacgaggccttcgggctcctcgacgccgccgcgcccgccgacgtcgacgccttctgcgcgcgcctcgacgcgccgcccaaagtcagggagaccgtcaagacctacgcggagaagatgcacgacgtgatcgtcggcgtcgccggcgagctggccaccagcctggggctgggcctggaggagcactcgttccaggactggccgtgccagttccgcatcaacaggtacaactacacgcaggagacggtgggctcctccggcgtgcagacccacacggactcgggcttcctcaccgtgctccaggaggacgagtgcgtcggcggcctcgaggtgctggaccccgccgccggtgagttcgtgcccgtggaccccgtcgccggctccttcctcgtcaacatcggcgacgtcggcacggcgtggagcaacgggaggctccacaacgtgaagcaccgggtgcggtgcgtcgcgcccgtgccgcgcatctccatcgccatgttcctgctggcgcccaaggacgaccgcgtgagcgccccggaggcgttggtcgacgcgggccacccgcgtcggtacaagccgttcaactacgacgactaccggaggctccggctgtccaccggcgagcgcgcaggcgaggcgctcgcgcggatggcggcgtgatgtcgtcacgcacgtgcaagccgttaattataggctcgcgcatgcatacgcctacacgagaggttgtctcgttaagccgttctattaaaatgtgtgggggagaaagatgactaccgtggtgccatgtggattgctatcgggtctgatcaataaaatcttgcaacacttgcacgtgcgattccatatcctagcacgggtgggcgccacgctagtaggtagagaccggagcggccaaaaaatggctacagcaccagtaggtgaactctcaagcaacactggctatcccacttctgacgttgtctctctcatcactatgtatgaccagcgaatgaagtgtttaaaaatctgacgccgtgaaa

SEQ ID NO: 23 - DNA, 903 bp, Zea mays
atggcggagatcccggtgatcgacctgcgcctcgccggctcgtcgcccgacgagtcggcgcggctgcgcgacgcgtgcgagcgcctgggctgctttcgggtgaccggccacggcgcgcccgcggggctcctggccgacatgaaggccgccgtgcgcgcgctcttcgacctccccgacgacgccaagcgccgcaacgccgacgtcatccccggcagcggctacgtcgcgccctgccccgccaacccgctctacgaggccttcgggctcctcgacgccgccgcgcccgccgacgtcgacgccttctgcgcgcgcctcgacgcgccgcccaaagtcagggagaccgtcaagacctacgcggagaagatgcacgacgtgatcgtcggcgtcgccggcgagctggccaccagcctggggctgggcctggaggagcactcgttccaggactggccgtgccagttccgcatcaacaggtacaactacacgcaggagacggtgggctcctccggcgtgcagacccacacggactcgggcttcctcaccgtgctccaggaggacgagtgcgtcggcggcctcgaggtgctggaccccgccgccggtgagttcgtgcccgtggaccccgtcgccggctccttcctcgtcaacatcggcgacgtcggcacggcgtggagcaacgggaggctccacaacgtgaagcaccgggtgcggtgcgtcgcgcccgtgccgcgcatctccatcgccatgttcctgctggcgcccaaggacgaccgcgtgagcgccccggaggcgttggtcgacgcgggccacccgcgtcggtacaagccgttcaactacgacgactaccggaggctccggctgtccaccggcgagcgcgcaggcgaggcgctcgcgcggatggcggcgtga

SEQ ID NO: 24 - protein, 300 aa, Zea mays
MAEIPVIDLRLAGSSPDESARLRDACERLGCFRVTGHGAPAGLLADMKAAVRALFDLPDDAKRRNADVIPGSGYVAPCPANPLYEAFGLLDAAAPADVDAFCARLDAPPKVRETVKTYAEKMHDVIVGVAGELATSLGLGLEEHSFQDWPCQFRINRYNYTQETVGSSGVQTHTDSGFLTVLQEDECVGGLEVLDPAAGEFVPVDPVAGSFLVNIGDVGTAWSNGRLHNVKHRVRCVAPVPRISIAMFLLAPKDDRVSAPEALVDAGHPRRYKPFNYDDYRRLRLSTGERAGEALARMAA

SEQ ID NO: 25 - DNA, 1614 bp, Zea mays
accacacgaattgcacatctccacagctcacgattccaacactagctacatatatatgtagctttctaggctactatatacactcaccaccaagtgtgaagtgtgtatatatagtgacagctactgcaatatatacatacgcgtcacctatatattagccaagctagctatatgagcttggttgcggcgccaatggcgatcgtcgacgtggccaacgcccagctgcagcaagcagcagcagcagctgccaagaaagacgaggacggccatgagcagcaggagtcgtcctacgactacggcgcgctgatgaaaggcgtgaggcacctgtcggacagcggcattaccaggctgcccgacaggtacgtcctgcccgcgtccgaccgccccggcgtccttgccgtctcgtcgtccgtggcgggcagcggcagggtcaagctccctgtcgtcaacctcgccggcctccgcgacccctgccagcgcgccgccgtgctggccacgctcgacgccgcgtgccgggagtacggcttctttcaggtggtaaaccacgggttcgggagcgacgtgagcggcgggatgctggacgtggcgcagcgcttcttcgagctgccgctggccgagcgagcgcggcacatgtcggcggacgtgcgggcgccggtgcgctacggcaccagcttcaaccaggccaaggacgacgtgctctgctggcgcgacttcctcaagctcgtctgccagccgctgcaggcggtgctcccgtactggccccagcagccggcggacctcagggacgtggccaccaggtacgccacggcgagccaccggctgttcatggaggtcatggaggcggcgctggaggccctgggcatccccacggccggcggcgtgctcggggagctggcagcgtcgtcgtcgcacatgatgacggtgaactgctacccggcgtgcccgcagcctgagctcacgctggggatgccctcgcactcggactacggcctcttcacgttcgtcctgcaggaccacgtcgagggcctccaggtcatgcacgacggccgctggctcaccatcgaccccatcccgggatcgttcgtcgtcaacgtcggcgaccacctagagatctacagcaacgggcggtacaagagcgcgctgcaccgggtgcacgtgaactccacgcggccgcgcatctcggtggcgtcgttccacagcctgccggcggagcgagtgatcgggccggcgccggagctggtggacgacgaggccggcaacccgcggcggtacatggacaccgacttcgctaccttcctcgcctacctcgcatccgcggacggcaagaacaagaccttcctccagtcaaggaagctgcctgctgctgctcctccatgcctctagctaactagatagctgcttattaatctgacagaataaaattaatcagttcagcgcacaattccacaagcgaaaacaaacctggatttgttttaattagctctgcccttcattattacattcaagctagctcttggtcaacgcatgcacacaagcttgagcattgactggtcccttttcaatcggttgcattgtactccctccgtaccaaaattggttgtcgctatagtattt

SEQ ID NO: 26 - DNA, 1212 bp, Zea mays
atgagcttggttgcggcgccaatggcgatcgtcgacgtggccaacgcccagctgcagcaagcagcagcagcagctgccaagaaagacgaggacggccatgagcagcaggagtcgtcctacgactacggcgcgctgatgaaaggcgtgaggcacctgtcggacagcggcattaccaggctgcccgacaggtacgtcctgcccgcgtccgaccgccccggcgtccttgccgtctcgtcgtccgtggcgggcagcggcagggtcaagctccctgtcgtcaacctcgccggcctccgcgacccctgccagcgcgccgccgtgctggccacgctcgacgccgcgtgccgggagtacggcttctttcaggtggtaaaccacgggttcgggagcgacgtgagcggcgggatgctggacgtggcgcagcgcttcttcgagctgccgctggccgagcgagcgcggcacatgtcggcggacgtgcgggcgccggtgcgctacggcaccagcttcaaccaggccaaggacgacgtgctctgctggcgcgacttcctcaagctcgtctgccagccgctgcaggcggtgctcccgtactggccccagcagccggcggacctcagggacgtggccaccaggtacgccacggcgagccaccggctgttcatggaggtcatggaggcggcgctggaggccctgggcatccccacggccggcggcgtgctcggggagctggcagcgtcgtcgtcgcacatgatgacggtgaactgctacccggcgtgcccgcagcctgagctcacgctggggatgccctcgcactcggactacggcctcttcacgttcgtcctgcaggaccacgtcgagggcctccaggtcatgcacgacggccgctggctcaccatcgaccccatcccgggatcgttcgtcgtcaacgtcggcgaccacctagagatctacagcaacgggcggtacaagagcgcgctgcaccgggtgcacgtgaactccacgcggccgcgcatctcggtggcgtcgttccacagcctgccggcggagcgagtgatcgggccggcgccggagctggtggacgacgaggccggcaacccgcggcggtacatggacaccgacttcgctaccttcctcgcctacctcgcatccgcggacggcaagaacaagaccttcctccagtcaaggaagctgcctgctgctgctcctccatgcctctag

SEQ ID NO: 27 - protein, 403 aa, Zea mays
MSLVAAPMAIVDVANAQLQQAAAAAAKKDEDGHEQQESSYDYGALMKGVRHLSDSGITRLPDRYVLPASDRPGVLAVSSSVAGSGRVKLPVVNLAGLRDPCQRAAVLATLDAACREYGFFQVVNHGFGSDVSGGMLDVAQRFFELPLAERARHMSADVRAPVRYGTSFNQAKDDVLCWRDFLKLVCQPLQAVLPYWPQQPADLRDVATRYATASHRLFMEVMEAALEALGIPTAGGVLGELAASSSHMMTVNCYPACPQPELTLGMPSHSDYGLFTFVLQDHVEGLQVMHDGRWLTIDPIPGSFVVNVGDHLEIYSNGRYKSALHRVHVNSTRPRISVASFHSLPAERVIGPAPELVDDEAGNPRRYMDTDFATFLAYLASADGKNKTFLQSRKLPAAAPPCL

SEQ ID NO: 28 - DNA, 1863 bp, Zea mays
tgccaccataccactagtgcaaggtcctagatttacacttggtgctacaccttgcttcgcccccttccttccttccttccttccttccctccttccttggtctctaggcagctagcagtgtggtgctgctgccggccgcctattggccgcctgggactgggatccattaattactgcgcgcgcgcggctaaccaaccaatcccagcgtgcgtaatctattgcccacatgccgacgccgtcgcacctcaacaagaacccgcgctacctggacttccgggcggcgcggcgggtgccggagtcgcacgcctggccgggcctgcacgaccaccccgtcgtggacggcggcgcgccgggccccgacgccgtgccggtggtggacctgggcgccgcggacccggcgccggcgccggcggcggcggtggcccgcgccgccgagcaatggggcgcgttcctgctcacgggccacggcgtccccgcggacctgctggcgcgcgtggaggaccggatcgccaccatgttcgcgctgccggccgacgacaagatgcgcgccgtgcgcgggcccggcgacgcctgcggctacggctccccgcccatctcctccttcttctccaagtgcatgtggtccgagggctacaccttctcgccggcctccctccgcgccgacctccgcaagctctggcccaaggccggcgacgactacaccagcttctgtgatgtgatggaggagttccacaagcacatgcgcgccctcgcggacaagctgctggagctgttcctcatggcgctggggctcaccgacgagcaggccagcgccgtcgaggccgagcggaggatcgccgagacgatgaccgccaccatgcatctcaactggtacccgaggtgcccggacccgcggcgcgcgctggggctgatcgcgcacaccgactcgggcttcttcaccttcgtgatgcagagcctcgtgcccgggctgcagctcttccgccacgccccggaccggtgggtggcggtgccggccgtgccgggcgccttcgtcgtcaacgtgggcgacctcttccacatcctcaccaacggccggttccacagcgtgtaccaccgcgccgtcgtgaaccgggacctcgacaggatctcgctcggctacttcctcggcccgccgccgcacgccaaggtggcgccgctgcgcgaggccgtgccgcccggccgggcccccgcgtaccgcgccgtcacgtggcccgagtacatgggcgtccgcaagaaggccttcaccaccggcgcctccgcgctcaagatggtcgccctcgccgccgccgccgacctcgacgacgacggcgacgccgccgtcgtccatcagcagcagcagctagtcgtctcgtcgtagccgagaccgatcgccggagactgatgctgatgatgatgcatatatacatgagagaaatcgtcgagtagactagccgattgcaaaagcaaccccagctgccgaaacctggcatatcgatcccattctctgctgcgcacatgtatgcatgcatgcgcttcgtccgttcgactcgtgtgtgcttgcttgcttgcgcgtgcagcagaactaattccgttccgcagctagctgctctgctctgctctgctggaatgtaattaagtagtagtatatggtagtagagaaaagattagctaggcgatcgatatagatgacgggccggggaagaagacgaattaattaagatcgatcgacgacgacgagctgtgcgtggctggctgtgttcttctctagcctagttacagaggccggctgctgctgcttccaatcgggctgcttgtcgctactgacgatcgttagtggatccattaactaatctggaattctggatt

SEQ ID NO: 29 - DNA, 1149 bp, Zea mays
atgccgacgccgtcgcacctcaacaagaacccgcgctacctggacttccgggcggcgcggcgggtgccggagtcgcacgcctggccgggcctgcacgaccaccccgtcgtggacggcggcgcgccgggccccgacgccgtgccggtggtggacctgggcgccgcggacccggcgccggcgccggcggcggcggtggcccgcgccgccgagcaatggggcgcgttcctgctcacgggccacggcgtccccgcggacctgctggcgcgcgtggaggaccggatcgccaccatgttcgcgctgccggccgacgacaagatgcgcgccgtgcgcgggcccggcgacgcctgcggctacggctccccgcccatctcctccttcttctccaagtgcatgtggtccgagggctacaccttctcgccggcctccctccgcgccgacctccgcaagctctggcccaaggccggcgacgactacaccagcttctgtgatgtgatggaggagttccacaagcacatgcgcgccctcgcggacaagctgctggagctgttcctcatggcgctggggctcaccgacgagcaggccagcgccgtcgaggccgagcggaggatcgccgagacgatgaccgccaccatgcatctcaactggtacccgaggtgcccggacccgcggcgcgcgctggggctgatcgcgcacaccgactcgggcttcttcaccttcgtgatgcagagcctcgtgcccgggctgcagctcttccgccacgccccggaccggtgggtggcggtgccggccgtgccgggcgccttcgtcgtcaacgtgggcgacctcttccacatcctcaccaacggccggttccacagcgtgtaccaccgcgccgtcgtgaaccgggacctcgacaggatctcgctcggctacttcctcggcccgccgccgcacgccaaggtggcgccgctgcgcgaggccgtgccgcccggccgggcccccgcgtaccgcgccgtcacgtggcccgagtacatgggcgtccgcaagaaggccttcaccaccggcgcctccgcgctcaagatggtcgccctcgccgccgccgccgacctcgacgacgacggcgacgccgccgtcgtccatcagcagcagcagctagtcgtctcgtcgtag

SEQ ID NO: 30 - protein, 382 aa, Zea mays
MPTPSHLNKNPRYLDFRAARRVPESHAWPGLHDHPVVDGGAPGPDAVPVVDLGAADPAPAPAAAVARAAEQWGAFLLTGHGVPADLLARVEDRIATMFALPADDKMRAVRGPGDACGYGSPPISSFFSKCMWSEGYTFSPASLRADLRKLWPKAGDDYTSFCDVMEEFHKHMRALADKLLELFLMALGLTDEQASAVEAERRIAETMTATMHLNWYPRCPDPRRALGLIAHTDSGFFTFVMQSLVPGLQLFRHAPDRWVAVPAVPGAFVVNVGDLFHILTNGRFHSVYHRAVVNRDLDRISLGYFLGPPPHAKVAPLREAVPPGRAPAYRAVTWPEYMGVRKKAFTTGASALKMVALAAAADLDDDGDAAVVHQQQQLVVSS

SEQ ID NO: 31 - DNA, 1439 bp, Zea mays
gacctccattttgattatctctatcctgtacgtgccgagagtccttcaaagccgacgacgagacgacgatgcagtcgtcgtcgtcatcagcctcgacgccggctgccgcttccggcctcgtcttcgatctcgggtctgcggcgggcgtgccggagacacacgcgtggccgggggtgaacgagtacccgtcggtggagtccgctggccgcgacgtggtcccggtggtggacatgggggtggcctgcccggacgcgacgcgggcgttggcgcgcgccgcagacgagtggggcgtgtttctgctcgtcggccacggcgtgccccgggaagtggcggcgcgtgccgaggagcaggtcgcgcgcctgttcgtgctcccggctcctgacaaggcccgcgcggggcgccgccccggggagcccacggccaccggctacggcaggccgcccctggcactccgcttctccaagctcatgtggtccgaggggtacacgttccgcgccgccaccgtccgcgaagagttccgccgcgtctggcccgacggcggcgacgactacctccgcttctgcgacgtgatggaggagtacgacagagagatgagggctctcggtggcaggctgctcgacctcttcttcatggcgctcggcctcaccgacgtccagttcgccaccggcgagacggagcggaggatccgcgagacctggacggcgacgatgcacccaatcctgtgtccggaaccggagcgcgccatcgggctgacggcgcacacggactcgggcttcatcacgctcatcatgcagagccccgtgcccgggctgcagctgctccgccgcgggccggaccggtgggtgacggtgccggcgccgccgggcgcgctcatcgtcatgctcggcgacctgttccaggtgctcacgaacggccgcttccggagccctatccaccgcgccgtcgtaagccgagagcgcgagcggatctccgtgccctacttcctctgcccgccggaggacatgacggtggcgccgctcgcgtccgctctgctgccggggaggaaggccgtgttccgggccgtgacgtggccagagtacatggaggtcaagcacaaggtgttcggcacggatgcgccggccctggagatgctgcagctgcaggtggatgaggaagaacaaggtgaaagggccgccaccacctaagccctaaggaactactagctgaatccataaactaataaagaattcgtgaataagggcgttggaagactggacacaacacaagagagttgctatatatcgtatttctgaaatttaaggcaaatatcttagttaaaaaactggtatatttaaatagacaatatatatctaaaataaagatagttcaccatttttacggtcgaacaatgataaagttatatattgtctgaatagtaacaaattaaagatttccaggag

SEQ ID NO: 32 - DNA, 1116 bp, Zea mays
atgcagtcgtcgtcgtcatcagcctcgacgccggctgccgcttccggcctcgtcttcgatctcgggtctgcggcgggcgtgccggagacacacgcgtggccgggggtgaacgagtacccgtcggtggagtccgctggccgcgacgtggtcccggtggtggacatgggggtggcctgcccggacgcgacgcgggcgttggcgcgcgccgcagacgagtggggcgtgtttctgctcgtcggccacggcgtgccccgggaagtggcggcgcgtgccgaggagcaggtcgcgcgcctgttcgtgctcccggctcctgacaaggcccgcgcggggcgccgccccggggagcccacggccaccggctacggcaggccgcccctggcactccgcttctccaagctcatgtggtccgaggggtacacgttccgcgccgccaccgtccgcgaagagttccgccgcgtctggcccgacggcggcgacgactacctccgcttctgcgacgtgatggaggagtacgacagagagatgagggctctcggtggcaggctgctcgacctcttcttcatggcgctcggcctcaccgacgtccagttcgccaccggcgagacggagcggaggatccgcgagacctggacggcgacgatgcacccaatcctgtgtccggaaccggagcgcgccatcgggctgacggcgcacacggactcgggcttcatcacgctcatcatgcagagccccgtgcccgggctgcagctgctccgccgcgggccggaccggtgggtgacggtgccggcgccgccgggcgcgctcatcgtcatgctcggcgacctgttccaggtgctcacgaacggccgcttccggagccctatccaccgcgccgtcgtaagccgagagcgcgagcggatctccgtgccctacttcctctgcccgccggaggacatgacggtggcgccgctcgcgtccgctctgctgccggggaggaaggccgtgttccgggccgtgacgtggccagagtacatggaggtcaagcacaaggtgttcggcacggatgcgccggccctggagatgctgcagctgcaggtggatgaggaagaacaaggtgaaagggccgccaccacctaa

SEQ ID NO: 33 - protein, 371 aa, Zea mays
MQSSSSSASTPAAASGLVFDLGSAAGVPETHAWPGVNEYPSVESAGRDVVPVVDMGVACPDATRALARAADEWGVFLLVGHGVPREVAARAEEQVARLFVLPAPDKARAGRRPGEPTATGYGRPPLALRFSKLMWSEGYTFRAATVREEFRRVWPDGGDDYLRFCDVMEEYDREMRALGGRLLDLFFMALGLTDVQFATGETERRIRETWTATMHPILCPEPERAIGLTAHTDSGFITLIMQSPVPGLQLLRRGPDRWVTVPAPPGALIVMLGDLFQVLTNGRFRSPIHRAVVSRERERISVPYFLCPPEDMTVAPLASALLPGRKAVFRAVTWPEYMEVKHKVFGTDAPALEMLQLQVDEEEQGERAATT

SEQ ID NO: 34 - DNA, 4095 bp, Zea mays
taaatttgtgatccttgtgaagttgttatatcatgaattgtgaacttgttgcatttgtgatcttttgtcaactttgttgtattgtgaagtttgatatgtttaccgatcgtattttagatttcgatcgttaccggtgtattttccgcaccaaacttttgtttccgatgttttcgaaataccgatatcgtttccgtttctatagttacccttttcaattttatttccgattaaaaatatgaaaacggtaatggttttagtgtttatcgaccgttttcatctctaatcatccctgccggtgaagtttaatttttcccttggctaaagagatgcaagctgctgtaaaatacgttaaaacaggcaaggcagccccagcagccagcatcgcgtgcccgtctatgtacatcagtggatacgtagcatctctagtgagtaatataacgattgcatttggctggaggacgtatgttatataagtatgtcatttaccagttgcattagtatcttccctaactcctataataactctcttcgtggaatggacgtagacgtatgctatataagtattaaaaaatagttttttaagctggtgtcctcaattttgctattgttctcgtttttatctttagttgtgtcacaaatttaatccgtacaacaaatcaaaaataccatacccttcttatattaattttctaacataacatttgtttagatattttcagtcgtgaaaatacaattctaattctaacgtcgtagtatcaaatcaaaccatccagaatttgaccaagcttaattataaaaaatataaaatttatgatactgaatagatagcattagatttgttatataatatatttttataaaataccatttttatggtataaatattggtactcctttactttaaactatagatagttttgactaaggatgcaactagaattgcatcctcttttcactgcaccttcattagttttaatatttatttagatgggcccttgcaaactgtagatatcatctcttgcaacattctttctatagcaccacgaaaatgtattgcggctttgaaattataattgaattagttgtatcatttctttcaccgatgcgttaaattcaaaattaagtgttatatttcttcataatttgttaaatatatagaccctataatccaccattatttactataatagcatacattaacattggttttagcctacactacgacactcgaggcattgaattttcctctatcaaagaattatatgtgtagtagtattgttcttgacaaaaagggggattaaaattaaactaccaatattgatacttatcttatcacatccatgaatacaatcaacactcttacaaaagataagatacaagattaaaaagtaccatgataatacattaagattattagcaatgcattaaattaaataaatgtgcaagtgaatcatgattttagttttatctattttacttttaaaatatgatattctctgactacttctaagcataaatgtgattctaagtcatgaccgatcgtgcttattcagaaaaatgaaggagacacagatttctataaaaaaaggttgtcatgggactattgggtcaaccatcttattcatttgggaaaataagtttagaacacatcaacccattttagatgttgagtttggccctaatggtccattgaccttacttttgtgggttgacatagaccatctatcccaagttattgttgtgtcacattccctgatatcatgaatctatattttagctttccgttttcatatttttagtcgttacatattttttatccgcgtactagattaaaactctagttgttgcaatacattttgttcatttttttctatttcttctttactaacaacatattctagttcctagctacattcttaagtaccatagtgctataaacattttttatcctacattattccacttaagaaattgaattttctgcataaaaaaattatatgtccagtagtgttgtcttataaaagcataaagtgattaaaattaaaaccattattgatatcttatttttcaaaaaaaaatataagcttatagaaagtgaattaatttcatggtaaattaatatagtttaaattgaattattagtgttattactatgtttattatcaatgaaacatttttcatggttgatataacttagtgttacttattttagtattttttatataattctagttaacttttagtttttgatttaaaaaaacgagaattgtgtccttttgtggagtgagtataaagaaagtaatatctgttcatcataatttggttttttaaggtacgtgaaacttgctttatatttggactcaagctatgtctaaatacatagtaaaaaagcaatatttctagaaaagacaaaacatcttataatttagaatcaaggaaatatatagattttatgtgcagtgagaagccatttacaatggaacgttcaacgttgggccaatagatattttgcgatatgatgatgggcatatttttgcatggttgtccctccactagctatagtttgatgatacgatacgctgcacacaccattgggttgtaccatgttagtgtagcaacagtagaaacccaattgtggccgtgaaccatgataatactaggtagagtgctagctagaggtttcaggctattgatgcgtgaattaaactttctgttgtgttgcgaggaaacgagtattgtgaaatatttgaaacggttttttttgtgaaagatttgaaacggtatttttgttgtgaaataaagatcaaggctaaataaattcaaactaataaaacatattaattgacggcctgaagcccccgcccccatggccccatgccatagcatcaggtcccacatgacatgaggccgcgcctccctctatgttggctccctgccttcgccgttgtcgtcgctcccgaactccctctcctcccctgttacaaatacccccacccgcccggacagcttccctgcacactcgcagctcgcacatctcatggtgtcctaagaacggcaagagccagctctgcctagcagcagcgcacagccacatccatggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcaccggcaccctcggccaagatttcgagccagtggggtgagtaaagaagaagatggcgccgaatttacatttataagtaggaccagcagaagcccctgcccctgggggccttagcattgcattcgactgatgaatacgcatggcaggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttca

SEQ ID NO: 35 - DNA, 7404 bp, Zea mays
cctattttgtgtctaatactcttcttatattaattgtttggtcaaactttagataaatttgactaatgatgcaattaaaactgcatcacctttactaaggtactgctttatatgtttcgacaaaattttcaattattctctatgtgttttaatctttgcgctacacctccattgatttaaatactcatttattttaaaccataacttaaattatatcggatctttgcatcctttctatggcaccatacatgaatcgatattttggctgcaaatttttaatcatgttagttttagcattttttcatatccatgtgttaagtttgaatcatgtgttgtttttatataatttattgaaaatatagatcctaaacttcactaatacttacaacaatagcatcatcatgtgttttaatccacgccacaacactcaaggcattgaattttcttctaccaaagagttgtatgtgtgtattgttctttaaaaaatagagtgattataattaaactaccagtattcatatgtaaaatgtatagacatctaaaataaaatttgcaaaaaacattgttgcagactttcaatataattaagaatgggttttagggtcatgatatatggtttgttaaagaaacttgtttttttttgcaattgataaactataaaatacattttcactattgtgtgcatatgtacttggtatacatagtggcatatatcatttttgtttactttgaggtttgaattatctatgttaaaattggataacatagatacattggtgtgcgtcctttggcccatttacttgactgaggagcaatactataaagtaaaacatatttggatattttatcttaaactcctagcataatattgatttaattatgaacaaatatatgtttaggtgatagtttcatgggtggtaaactatataagaaggcttaccatgatctttgcaaactctaggctatgaaagagttccatgatttgtcttagaagcatagacaaaacagtgataatgatctaaatcacacttatggcactgatgaccatatatgcaaagctaaatgcatgttaagttgtattatatcatatgtttacaatgactatcgcatataacgaggaatacattgtctatatagatagctattactgtagtagtgccaaatgttggacaacatgaatcataatcttcaaacctagagaaattgtagtcagtcgtacacatatcgtctagtaagttgtctatactttttatttattgtatcaaattttattgttatcttgcttgcttgtttgtttgtaccatagacacaatatggtcaaaaagtggtcaatcgattcgaagaagattgcaattgacgagtgctaacagttgatccttttgttgtgcacgctagcggagtagcatgaaaagagtaaaatatgaaattagcgttctaaactgtttgtgctataggtacttcgtatttaatggagtgactaactataggaaggtgagagctcagaagtcagcaccctcacacagagttctagagttagtggtcatcgaaccacgacaaactacatgatgagcagaagaggcaacatcaagactatgatcaatagtttcgggtcaatgaatgacatcgtgatgagtatttatctaactatatagaacaacaacacatgatgttttaagtaagttcaactgatcttctattgctatctttaagtatttaacgtagcgaataatgttttatctatttcattcataaataatgttgtgacaaaaggggataaccatcacttttaccatgttctagataccacaaccatctccaccatcataatgggttcttcattggtgcttggacctcaaataatcatatctatagccaacttagctcaattctaataaaattaggcaacttggcttcattgtagcaaaaatagccaacttagctcaattttatctaaacttagctaatctagcacaacttagatcaatattaggaaaaactaatcaatctaatctagctcaactatagcgaaagatagatattgtagcataacttagtagatctatctcaaattttagcaaaaactaatcaatttagataaactctataaaattttaatcattatgacttatttccaactaattgtaacttgcatgatttttatgttccttctttataattagcaacacctaaagacacgaatgatgaggggtctaacgcattcattaaccagttgttaaataatactctaggtagatgataagaactctaattattctatgaatctaagctaaaagatgtttaatatttaagtattggtgtttattatgttatttagaacgattcatgttacttaaagatttgttatgatttttaaatatgattatgataatttatgtggtgtggattaacttgtgaacatatgtgatgtagatgaatatgtatgttgtggatggaaccatatgaatatatatacacactcatatactattcgttggtgtaggtaaagcttcatccatcggtaattactaaatggtcttcagtcattaccactaggtgaagcttcacacgaccgataattattgaagaacgctcattaatttccggtaatggcttattggccttcactagtcggtgaaaattagctatttttataccaataaaaattagctaatatatgtaaaccaggtctaatttttatgggcctcttaccgaccaaaattgattagattattgttacaatagttttagtcaaaagctagctatgctataaaaattttgaattaaagtgagtttcgtaataaaaattgcatacttttaaaataaaataattaaaaaacagtttttagaaatacaatcaaacaccttatgctataaaaaaattgtaatgtacctacaaatatataatactttactttaaaataggcctgtgccttctcggctctatatgggctgcctccaacgaagcgccatggccatgggctccactgtgtcgggtcccacatgaggccgcgcctccctccaaatgttccctccctgccttcgtctttgtcgttgctcgcaaactccctgtcctcccctgttacaaatacccccacccgcccggacagcttccctgcatacttgcagctcgcacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcggctaccacgacggcgccgcgtcgcctgtcgtcgtggactacttcgtcggcaccctcggccaggatttcgagccaatggggtaagtaaggtagtaagaaggagcgccggtttacatttaccgcacgtcggcgtgcggtcgagtcgggactcgggagacgtatgaacccccgtcccgtcccatgcatgtgtggcaggtgggtgtaccagaggtactgcgaggagatgaaggagctgtcgctgacgatcatggagctgctggagctgagcctgggcgtggagctgcgcggctactaccgggagttcttcgaggacagccggtccatcatgcggtgcaactactacccgccgtgcccggagccggagcgcacgctgggcacgggcccgcactgcgaccccacggcgctcaccatcctcctgcaggacgacgtgggcgggctggaggtgctggtggacggtgagtggcgccccgtccggcccgtcccgggcgccatggtcatcaacatcggcgacaccttcatggtaacgaaacgaaagcgctcgctcctctgttttccttggccgctcttgtcctgtgtgtatattcagttgagctctctctgtgctgttatttcccgaatcctagtggacctaaacgggcaggttattacagcacgcacacgtaggcatgtcatgtagctagtacatacatagcgatgccgatgcaaatgcaatagagacatgcgttcgagttggttcctatctcggcgggctacggcaggtacacgcggccgcggcgcgctctctctagtctatccgcggccgcgcccaggccgatcgaggcttccgggggagagttgcgacaagagaacggaccgagggggtcggctagcggtagcaagttccctgttggtttgtggcgttggagcgttgcggagaggcttgcgcggcggcggggacgtcgacggggacgtggcggggagacgatacgatgggtgccgggcaggtttccgaattccaaacgtttttgtggcgtgcgtccatggggcgcccccaaacttcggacgtttccggcgctccaacaaatcttctcgcttcacacgtcaccgtcgtcccggattcatttgcctcgtcgctccaccattcgctgctctcctctccacgtactcttaccctgacctttgggaaagaactgaacattcgagatgcacaacagttcaaatataacatatgcagcacaagatcgttcgactgctatccgacaagccaacaacgtgcccagtagaactgaatgtacctgtgatttccagcactaacttacagcaacgttgtgaaaaaacaaaaacgaaaacaaacggcagaaaaaacagatgtattgttctacagttacaccaaatattttctggtcctttcagcaccaacaagagccatacgcatatctagaagacaaaattcctctaatttcacccctacgtggtagcagttcctcctcaacacagttcacgtgctagcgtcgagttctttgggccgccacatcgacttctcgacgcagagcaggccctcgctgcccttggtgtaggtcatccgcacctcccactgcacggacttggccatgctctccagctcatttatcgtgtccgcggtgtccctcacgatcagcttgccctgtggcctcagtacacggtcgacctcggcgaaaactgcagccagtttgcatctgtaaacaggcaacacagatttttagtatctaaaacactgcaggcaaacgccacaggttttagtcgcaagaagcaataaaagcatgcaaacaatgctacgtgtacgtatcaaaggaacatgtcaaaactcgttgcatgaacgatcattgatgtttccttgctgaactagtcacatcagtctgcttcaacttctgggtttcactagtagatataccagaagggtagaataatgtgaagagcaagaaatacagacctctttctgagctttgagaacagatggtccgcgtgcagaaggtcatacgttcttgggtaagtgctgaaagactcgcaccagtcatggtacatgccaaacaaaccgcgctcgtagatgatgggcagcgtgtctggtgaatcgatcggcacgatattcatgacccagaccttttggtccctcagagctgcagcaaaactgccatgcaacaatgtaaagcattagtcaagaagaaggtgtacagtgcatttctccttgtcaacagtcttcagtaacaaaaaaaaagtgttatgcttgactgaatctttcaaagaaatatgcttgatgacttatggtggacaagttgcctgttatagtgttatgttttaattaactatgtgccagcttgggtaactagtagttatgtagtgtgatctgaattaccaaaatataaataaataaataaacatgcccaagaaactacgaaaaccatttacttaccctccatagacagctctcatgtccatgacatttctcactttggaccagtcaattcccatgccattcacatacgatttacttacaacccgtttccagtgggcattatctgcctcaaaatcttcatttgcaggctttccatagacaccaaccttggaaccatcaatccagaaaggggtcttctcaagcctttgcggccataactctggccattttgatcctcggacttttgagccaccaggcagtttgtgcatgcatgcttccaacggtacattcctgcaaatcaaaaggctgtgtaagcaaagcagagaagcacttttctccattgaaaatatactcttctcaaagaaccgaaaccataccaagcagcatctgcatcatcagattccttgcacaatggcgggctgttttcagatcttttctcatagcaaatattgtccattggtttctgatatatgaccataccaacttggtttaacttatccttagtcttgttgaccatcttccagcacatggactttgtcaaagtagacatggctgaaaagggtatgtggccacatgttatgttagaaataaaattcaattttgaacagttggtccatagcatgtattttgaacaaatgcaatccttctccatccatgaaagaagttgacccttcatacttaggattattcagtactttcactcatgtctgctgaatttgttctcttggtagttgctatacaagaaagggggaagtacagagtagctaaacttatacaagctatagtctgatatttgtatgaaacataaattttggtatggatgtcttattaaaatgggaggttgtataatatttttctagcctacctcaacttgcttgagactaaaaggctttgttgttgttgttgaggctgtatggtgctttgactttacaaatcaagttatcagctaccctacttatggatatacacctctcataaaatgatggtaagaagtttcgatatgtcacattaacataagaacttcattcagttagggtacaacgaagttaagtagttacggaaataccattccaaatctcaacatcctctgggagcttttggtaaacaggagtggcagaccagacaaagtaaccaccagggcgtaacaagcggttcaattccagcaaaagcatgccacctaaaagtagcgagccagcaataagattcagttctatagcaaatcaataaatgaaaggaggacatgtcaatatgtaaccagcaggacaaaccttcgatgtgccaaggga

SEQ ID NO: 36 - DNA, 1788 bp, Zea mays
aatcccagcgtgcgtaatctattgcccacatgccgacgccgtcgcacctcaacaagaacccgcgctacctggacttccgggcggcgcggcgggtgccggagtcgcacgcctggccgggcctgcacgaccaccccgtcgtggacggcggcgcgccgggccccgacgccgtgccggtggtggacctgggcgccgcggacccggcgccggcgccggcggcggcggtggcccgcgccgccgagcaatggggcgcgttcctgctcacgggccacggcgtccccgcggacctgctggcgcgcgtggaggaccggatcgccaccatgttcgcgctgccggccgacgacaagatgcgcgccgtgcgcgggcccggcgacgcctgcggctacggctccccgcccatctcctccttcttctccaagtgcatgtggtccgagggctacaccttctcgccggcctccctccgcgccgacctccgcaagctctggcccaaggccggcgacgactacaccagcttctggtacgttgcgttgcgtgcttgtgtgcgcgcacacctgccgaccgcggccacaccgtacgcaacccacgcgtacgtacgtgcgctagctacctgcttcgctcgcttcgctcctctcgcctcgccatgcatatgcacgtacggccgtacaggtacagcagcaggtcacacgcacgaacgcacgcacgcaccagcaccgatatgatacatcatcgacgtgtcgtccccccgtctaaggccatgcatgcatgcaagcacgcctagctagcccttttggcttgctagctgacgaggggagctaggacgagcatacttactgtgcgcgtcatgctcaattgctcacactatactactacttgttactacagtgatgtgatggaggagttccacaagcacatgcgcgccctcgcggacaagctgctggagctgttcctcatggcgctggggctcaccgacgagcaggccagcgccgtcgaggccgagcggaggatcgccgagacgatgaccgccaccatgcatctcaactggtgggtatatattattgtctgtcatgttgtcgtcgtcgtacgcgttgcggttgggtgtacatgtatataacacaaacaacaaaaaactaacgccgtgccgacgacgacgacgatcatcaggtacccgaggtgcccggacccgcggcgcgcgctggggctgatcgcgcacaccgactcgggcttcttcaccttcgtgatgcagagcctcgtgcccgggctgcagctcttccgccacgccccggaccggtgggtggcggtgccggccgtgccgggcgccttcgtcgtcaacgtgggcgacctcttccacatcctcaccaacggccggttccacagcgtgtaccaccgcgccgtcgtgaaccgggacctcgacaggatctcgctcggctacttcctcggcccgccgccgcacgccaaggtggcgccgctgcgcgaggccgtgccgcccggccgggcccccgcgtaccgcgccgtcacgtggcccgagtacatgggcgtccgcaagaaggccttcaccaccggcgcctccgcgctcaagatggtcgccctcgccgccgccgccgacctcgacgacgacggcgacgccgccgtcgtccatcagcagcagcagctagtcgtctcgtcgtagccgagaccgatcgccggagactgatgctgatgatgatgcatatatacatgagagaaatcgtcgagtagactagccgattgcaaaagcaaccccagctgccgaaacctggcatatcgatcccattc

SEQ ID NO: 37 - DNA, 1698 bp, Zea mays
cgtgccgagagtccttcaaagccgacgacgagacgacgatgcagtcgtcgtcgtcatcagcctcgacgccggctgccgcttccggcctcgtcttcgatctcgggtctgcggcgggcgtgccggagacacacgcgtggccgggggtgaacgagtacccgtcggtggagtccgctggccgcgacgtggtcccggtggtggacatgggggtggcctgcccggacgcgacgcgggcgttggcgcgcgccgcagacgagtggggcgtgtttctgctcgtcggccacggcgtgccccgggaagtggcggcgcgtgccgaggagcaggtcgcgcgcctgttcgtgctcccggctcctgacaaggcccgcgcggggcgccgccccggggagcccacggccaccggctacggcaggccgcccctggcactccgcttctccaagctcatgtggtccgaggggtacacgttccgcgccgccaccgtccgcgaagagttccgccgcgtctggcccgacggcggcgacgactacctccgcttctggtacgtacgagcgccatgtcacgtgcttgtgctttcatgcctcgtaccgtcgtcgtgctgtacgtgttatgtttatcggccggtacgtcacgcgtgctacactggttaacgacgtgagcgtgcccacgttgactgcatgcatgtgcatgcgcgcgcccagcgacgtgatggaggagtacgacagagagatgagggctctcggtggcaggctgctcgacctcttcttcatggcgctcggcctcaccgacgtccagttcgccaccggcgagacggagcggaggatccgcgagacctggacggcgacgatgcacccaatcctgtacgtacgtcaaaaacgaatatctgaccaatgcaaacgtttttctgcaatgccagtcatccactcatcctgtacgtacctctggactctgcttgtccatctactgatgacacgtatggtaggtaccccaggtgtccggaaccggagcgcgccatcgggctgacggcgcacacggactcgggcttcatcacgctcatcatgcagagccccgtgcccgggctgcagctgctccgccgcgggccggaccggtgggtgacggtgccggcgccgccgggcgcgctcatcgtcatgctcggcgacctgttccaggtgctcacgaacggccgcttccggagccctatccaccgcgccgtcgtaagccgagagcgcgagcggatctccgtgccctacttcctctgcccgccggaggacatgacggtggcgccgctcgcgtccgctctgctgccggggaggaaggccgtgttccgggccgtgacgtggccagagtacatggaggtcaagcacaaggtgttcggcacggatgcgccggccctggagatgctgcagctgcaggtggatgaggaagaacaaggtgaaagggccgccaccacctaagccctaaggaactactagctgaatccataaactaataaagaattcgtgaataagggcgttggaagactggacacaacacaagagagttgctatatatcgtatttctgaaatttaaggcaaatatcttagttaaaaaactggtatatttaaatagacaatatatatctaaaataaagatagttcaccatttttacggtcgaacaatgataaagttatatattgtctgaatagtaacaaattaaagatttccagg

SEQ ID NO: 38 - DNA, 4095 bp, Zea mays
cggtctaagtgaccgtttgagagaggaaaagggttgaaagagacccggtctttgtgaccacctcaacggggagtaggtttataagaaccgaacctcggtaaaacgaatcaccgtgtcatccgccttatttgcttgtgatttgttttcgccctctctttcggactcgtttatatttctaacgctaaccccgacttgtagttgtgcttaaagtttgtaaatttcagattcgccctattcaccccctctaggcgactttcatataaatattgggagaaatatgaaaaacaaatgaaggtcgaacgagtcagagacaccataaaaaagaggtcgtcttaactagggtgctaaacctcaacattgtagtagatcttagtactgagtttgacatctttgacaccaacaagatggtgatacgttactttctacgttaacttgggtaggtatatcgactatagtggcctataacactaggctatgtaatatgatattgtgttgagtctttataaacatgattttttttaaaaaaaagagctaaaataaaaaatagaaatcgacggtacgatgcaagttcttctcaagacaaccaaacgcacccttgcccctttattgaaattgaagtatgtgctttatcaaatgtttaaatactaattataagtattaaatataatttaattataatactaattatatagataaagactaaataacaagacaaatttattaaatataattaattcattattaacaaatacttaatgtagcacgatcgaatcatggactaattagtcttgatagactcgtcttaccatttaatcataattagttttgtatactgtttataatatttctaactagctagtattaaacttttgatgtaacctaactaaagtttagtcacgccaatacataaggactcggatcgttcgatcacccatgacatcacgtatactaagagcatctccaaaagctctccagaagtctcccctaaatctatttttttgggaaaaacacaaaaacatgtctccaacagttcccttaaagcgcccccaactttttcatagcccttaaaactccctcatttgtagctacaaatgaggggttttttgggctccccagaaacaaactgttgatttaagggatctgttggagaaaggattaaaatttaccctcacttattatttagatgtcccttaaaactgattttgaggagtcgttttatgtagagctcttggagatgctctaacacaccgagcacaaccgcatcatcaatcaaaacaacccaaagtttgttcggtacaagtcatcagcctgtgtacacacatcagcctcggccccgggagaagcgctagcaaacaaggttcacctaaaaatccatccagattcattgaatccaaccagcacaaacgtcccatttattaatcacctcatcacaggtccccccagcctcactctcgcgccggctcaaggtacattgcgtgtcctagccaagacacgcagctcatctcagcctcacacgcacagcaagagcgaggcgtgattcgccatgggcggcctcactatggaccaggccttcgtgcaggcccccgagcaccgccccaagcccatcgtcaccgaggccaccggcatccctctcatcgacctctcgcctctggccgccagcggcggcgccgtggacgcgctggccgccgaggtgggcgcggcgagccgggactggggcttcttcgtggtcgtgggccacggcgtgcccgcagagaccgtggcgcgcgcgacggaggcgcagcgagcgttcttcgcgctgccggcagagcggaaggccgccgtgcggaggaacgaggcggagccgctcgggtactacgagtcggagcacaccaagaacgtgagggactggaaggaggtgtacgacctcgtgccgcgcgagccgccgccgccggcagccgtggccgacggcgagcttgtgttcgataacaagtggccccaggatctaccgggcttcaggtgacgaaattaactatatatccctttcgatcatagttgcgttaataaattaagggaatcgtgagcgtacgtacgtaagtttccgcagagaggcgctggaggagtacgcgaaagcgatggaagagctggcgttcaagctgctggagctgatcgcccggagcctgaagctgaggcccgaccggctgcacggcttcttcaaggaccagacgaccttcatccggctgaaccactaccctccttgcccgagccccgacctggccctcggcgtggggcggcacaaggacgccggcgccctgaccatcctgtaccaggacgacgtcggggggctcgacgtccggcggcgctccgacggcgagtgggtccgcgtcaggcccgtgcccgactcgttcatcatcaacgtcggcgacctcatccaggtacgtgcccacctgatgaactgagctgaacgtaggttgcatgcactgcatgtgtataggcttctcagatcgcttcgtgtggcgtaaggtgtggagcaacgacaggtacgagagcgcggagcaccgggtgtcggtgaactcggcgagggagaggttctccatgccctacttcttcaacccggcgacctacaccatggtggagccggtggaggagctggtgagcaaggacgatccgcccaggtacgacgcctacaactggggcgacttcttcagcaccaggaagaacagcaacttcaagaagctcaacgtggagaacattcagatcgcgcatttcaagaagagcctcgtcctcgcctaactactgctactgctaggatccatgccattgccatgtcgtcttcagattcagagcacgccatgtcgtcgctagcttcgtggtagaacaaataatgatgtgcgtgctgtgtgtaagcatggatatggatgtgaatatgtaatatgatgagcactcctactttggtatgtttgggaataacagacttgtgttggtctggttcattatttgtaagaaaatcaaaaagagttagtagggcaggaggctaaccacagtcatgctgcaccacatccctggtggaaagctggccgggttacgctacgctcgtgcagccagattactgcagggccgggatatgcttccggtggaaggaaggggacggtggctgaggaccatggggctggagcctgggagagaggtcgagctagaagaaagggggagagagaagacgcacaacgaagatgggtcagccagggatttcgacccaagggggagctagtggattttgggagaaaacagaaaagagaaaagagaaaagaagaaaaatttgttggtgtgaacacaaggttgatttgtcttttcttatttggattgatgatgagtcgtggactaaccgacccgtgagctattgtgtcgtataatcatgtctctcggtttctggtgtgcaggtttgaagcacagagacggtggtcgacgcaaaggtgaacgtcatgcaggttcgtgccgatggaccgggagcagtgaaagacgagcgttgggacttgaacaagggaccagagtcgccggatgactagccgcagtggctgacgcctggaacacgcatagacgtgaggacgtggtagagcaggtgaaaatcgcctagagggggggggggtgaatagacaaaacctaaaaattataaactttgaacacaaactttacctgaggttaccgttagaacgagtattaatgaaatcggagtgcggaaggcaagttcttcttgctacgagttgcttaatcaatattgataactttgggagtcaactcaaaatgatcacaagcaaaagaactagagagagaggagaggaagaatcaactcgcaaagtaatgatcaacacaaatgaacacaatgatttatttctcgaggtttggttccgaagaacctactccccgttcaggagtccacataggacatgtctctttcaaccctttctctctctcaaatggtcacatagactggttcagttgagagcacctagaggggggtgaataggtgatcttgtaaaatcaaacactaatagccacaaaacttagtttaaagtgttagtacggctaagtagctttgaagcgagttattgtgaacacaacaat

SEQ ID NO: 39 - DNA, 726 bp, Rice tungro bacilliform virus
tcctacaaaagggagtagtaatatttaatgagcttgaaggaggatatcaactctctccaaggtttattggagacctttatgctcatggttttattaaacaaataaacttcacaaccaaggttcctgaagggctaccgccaatcatagcggaaaaacttcaagactataagttccctggatcaaataccgtcttaatagaacgagagattcctcgctggaacttcaatgaaatgaaaagagaaacacagatgaggaccaacttatatatcttcaagaattatcgctgtttctatggctattcaccattaaggccatacgaacctataactcctgaagaatttgggtttgattactacagttgggaaaatatggttgatgaagacgaaggagaagttgtatacatctccaagtatactaagattatcaaagtcactaaagagcatgcatgggcttggccagaacatgatggagacacaatgtcctgcaccacatcaatagaagatgaatggatccatcgtatggacaatgcttaaagaagctttatcaaaagcaactttaagtacgaatcaataaagaaggaccagaagatataaagcgggaacatcttcacatgctaccacatggctagcatctttactttagcatctctattattgtaagagtgtataatgaccagtgtgcccctggactccagtatataaggagcaccagagtagtgtaatagat

SEQ ID NO: 40 - DNA, 165 bp, Rice tungro bacilliform virus
acgaatcaataaagaaggaccagaagatataaagctggaacatcttcacatgctaccacatggctagcatctttactttagcatctctattattgtaagagtgtataatgaccagtgtgcccctggactccagtatataaggagcaccagagtagtgtaatagat

SEQ ID NO: 41 - DNA, 2000 bp, Zea mays
ctgcaatatatacaccaaaagtattataaactgtcatatatatgaccaaaacctttttattttagaaaagtatattaatcatggtatattaatcaaagttgttgttggggctgcaaaaatcatacccttcttccacaagctgttccttgaactgcaggtactcaggaactctcagctcctcaacagcgagctcactgacgttgaccctcacatactcccagacaccaggcctagggcggatggcaagtgcaacccatggggggatgacaatcgcctcctgtaagataatagagctagaatgattaaagaaggtgcacactacaaaaggaacagtgctgtccagcgagatctgaatctgatgcaaacctgagctgccctcaggacatcctcaaaagcaccatccttgagcttctcgcgctcagcctcagggatcgcattgttgtactcggcaatgatctggtggggctgcagcataccctttccaaggtttttcagcctgcgcaaaacgatgtgccaaataacatcagactatgccagatctataaactcatcaaacatatacaatttcaagaaatagtttagacgtatgatcagcagtcagtagcgtgggaacatatgcaacatagcgaagaggcacaacagcaaattcattcgaaaaaatgaaaacaaagattcctctcttttaactgaacttctcgaaacccctttcatgcctacacatccgatctagtcagatgcctatgcgttcatgctgaacagaacgtgtcagaactaagcataaactggttagcaagcattatcgtattcgatagaccctttagtaacaagctatacattgggtaagttcagactccaatcattctgttcagaaacatcgtattgaatataaaactaaagaacacacatgcaggtgcagccagatctaacagcagtttacagtcggtactaaaaaaagcatggtgtatgtatgtatcatcagtatccagtactaggtttcgacaaaatcctggatgctaattaaatactcatcttattagggaacacaggaacattatgtctacagcattgaatgatggccacatcatgctagatctaacaatacataatatgatggaactggtcttaaaaagtcgcattcgctcaaataatacccgtagcaaaataaatgtaaacttgcagacgaagcgggggaaatgagggcagacctggtgaagacggcgacaagctcattggggtgggcagagagtgagtcgccaatgcgctccctgacgctgtggaggcggctcaggacacggtcacctgcaccttcccccattgctgtcctcttcctggatcctcaggcctgcacagcgaaaccgaaacggaagcggaagcttcagtcagcagagaaaactgaaaccgaaaaacggttcagatccgttgacataaaagctgcgatgacatcctaaaactaaaacccctccagcaagacataaacccaactgccaacaaccagtcttttaagtctcgacacacccttgacgctgcgccacgaaactatattgcaggcaagaaaccaacagaacctaactctggaaggggggaaagaaacggcagacaggagcaagacccaaaaaaaaacgactcagatcctggtactatagtcctagtacctagaccagaaagaagaaacaaccaatacaacaagaggcatacaagaactgaatcgatgaactgaaacgcttcagaggaccgaggaatggcggagaagggaggcgcctatttatacagatctgacgagagaaccgaacaaaaacacatcgatgggaaccatggagaagaaaagggctggccgcatggcaccaatggcctcggcctccaaaaagccgttgaatccaaagcaggcgaggacgaagcgtgacgcggcagggtacttctctagaaaagcacggcatcagcaaggtgggggggctggggttccttattgcaggcaatcacgaggtgattagcacaaacggaag

SEQ ID NO: 42 - DNA, 2000 bp, Oryza sativa
ctgaaatatacatcagagatattacaatgacatatatatcgataaaagaaaaataataaaattaagttttaaattttaagaatatatgtttttagtatcccaattatgcagatttcatacccttcttccacaagctgttccttgaactgcaagtactcggggactgtcagcaactcaacagcgagctcgctcacattgaccctcacatactcccagacaccgggcctcgggcggatggcaagggcaacccatggggagataacaatcccctcctgcatgataaaaaacaattacaagttaagttagagcaagcggtagagtaaagatggatctctgtgatgcaatgaaatctgaatctgattcaaacctgtgcactcctcaggacatcctcaaaagcaccgtccttcagcttctcacgatcagcctcagagattgcgttgttgtactcagcaatgatctggtgggcctgaagcattccctttccgaggttaaccagcctgcgcaaataacagtgtcaacaaaaatatcaggccagatctatcaactcagcctataaatatctcaataagataattttagcacttgagcatttgcgcataataagaaaatttgctattagccacttaaaaagaccatatatgatctgtttgcattgagatgaattaaaaatttcattgtagatatgaaatgattagttttgaccatttaattggacttaatgaaatatgcgcgataatcagatctacgcgctcgcgccaatagatctagtaagatgtaggttttttattttttttgtgaaactttgctaccacaacaagcatctgtaccagtgcagaattcattacttgtattcagtttgtaaaccgtatatataatataaataacatgcacatgcagtcagatctagcactaccagtccacagtaatccaaaactacatttgtatatttcatcattattcagtagtactaggtttgtacaaaatcttggctgcagaaggccgcacttaaatattcattctaatcagaaacttaaaaaaaaagtgactacaaaatgattgcatccaattcagtaaatatgagccattcctggccagatctaacaatctcaacaacaaagatcctatatgaacatctccttctaaaagaaaatacagtaacatctgaaggcagtagactagaaaccaacaaaatctaatgctgggaaatcactaaatcagcacgaacctggtgaagacggcgacgagctcattggggtgggcggagagggagtcgccgatgcgctccctgacgctgtggaggcggctcaggacgcggtcgccggcagcttcccccattgctctcctcttcctcttggctcctcaagcctgcgtgcacaaccaaccaccatcatcagatacatccagacccagtcaacacaatcactccaggaaaaaaaaaagtcaagccataaaccccaaccaaaaaccacgcctttgacaaacactggaagaaaaagaaaatcgcagctttttcacaagcaatctagaagaaaagaaaaagaaaagactacatagcagctataattgactgagaagcatacaggaatcaaacaatggagaaggggagggaggaagaacaatgatgctccaggctgaggaccgaggaactgggtgaagcggggtaggcgcgtatttatgcagatctgaggagagaaaccaccaaaacaatccgatggtttcaacgaaaaagatcgtcgcttcttgctgcaccagctcacccatagccgttgagatcgaagctaagctagcagcagcaaagctggaacgaagagtgacgcattcaagctcctctcctctcctctcctctcctccggagcacgaggccagcatgggatggattggggtttcttgttggccatggcaaaggaggaggtcattaacgttgacacggcgtaatttaattaaatcttatcttaaaatatgatttaagtggtagtaacaaggaagattaatactatgaa

SEQ ID NO: 43 - DNA, 2000 bp, Oryza sativa
gctgtttaagaaaaacagaagtaaaattcagtcactgttattttgcttcagttataatctgcaaatcgtcgttctggtacttactgtccatcaacaagctgttccttgaatgccaagtactcagaaacactcagctcttccactgccaactcacttacattcacccgaatgtagtcccagacaccaggccttggcctgatggccagtgcaacccagggcggcagcacaatggcttcctacatacagtcaaggaagtaagttagaaagactggtatttgactttgagttgactatcataaccatcctggctcattgccaaatttacctgagcagcccggagaatgtcttcaaagggagcatatttctctttgtcagcttcgatcaaggcatcgaactccgcaagcagctggtgacgctggagcattccctttccctggttaacatacctgcatagagtgatatttaagaaatagaaccaatgcttagatctcacatcctttctgcggctgaactatgttaatggcactaccacataaacctgatttttacttcttatttttaagaccacatgatctgtacttaatctagctatgaacaaacaatatttcaacatcatctaagattcatgactcaagacaaaaatgttagagctcatcacagattattatagataccatcattaaaactaaagagatgcataaccttgtcagctaagaatttgtaacatactaacatgttatcgtttcacatctgggttgactaagaactaaccaactgtatggataaaatcattgaaaactcaaaacaattagtagcaggttccaagaagacacaagatattatattgagatcttcacctagagaagagtgcaatcaactcattgggatgagacgagaaggtggcaccgaggcgttcgcggagactgtggaggcgagctagcttggcagccatgactcaatttcaggaactgcaaagaaaggttacacttagcaacacgtaccaaaaccactcacttgcacaagaataattagtcaacagccatcactaagcattgcaagactatctctgaacaggaaagccatgctaaatcaacactaataacatcacacaaaagcattggaagatcaaaacataactaaaaacagctgtttcatctacacaactgaaagcatctatggtttacgaagcagagtgcgagtactgattcaaaataaatcaacctgaaccaatatactctgacaatgttttcaaagggataaaagaaccagctttatcaaatggatttgttgggttttagtaagtatcattgagataccgatggcatatctcaaactttgcaaaattataatggcatggttccaaattaccctttagtattagcaccagttagatcctaattcctaaatccgataggacagagcgaaagatccctggagatatgaagatttggctacagattaagcagagccaacatgaagttccgaatattatgaatccgcaagcggggagatcaaagagaagaatacggaaggtcgcgactccatgaaagaatccaaccaaaaacccaaagatttttctcagttcaaaaaaaaaaaacccttcatttttggttcgccatccaccgacaggcaccaagacattcctcaggaagcaaaaaagattaagcagaacaagtgataagcaagacacagtatcaacggactacgagtcgagaaaatcactgaggcgcgattcttactgcaccaagtaaaaaaaaatttgggggcaaaaagaactctgcaatggggcggagcaacgtggcagcaaaactaaaggtcgaggatttgaggttttttgccggttttcctcgaaaccccgaatccgctcatagtaaacccactaaactgcagcagaaacccccctcttggttcagatttaccgaaagcagtaaacccaagaacatgtcagcaaaaactcctgcaagattcagctgacgacccaccaaagaatcgcaagaaat

SEQ ID NO: 44 - DNA, 2000 bp, Oryza sativa
tggcggacgcgccacgcacaaacacaaacctgcacacccctgtgtcagaggaggagaggccaagaaaggaaatcgagtggaggaagtgaggagcggcggagacgtaggaggaggagggggagatggaaatggaaagccgcgcgagagaggaggcgcgtgctggatgggaggaggaggaggaggtggtgggtttgtgtttggagagacgagcgagagaggcgaagcatttaaagggaggaagagggggagagagagagagagagagagagagagagagagagagagagaaaggaggaatataataaagggtggtgcacctgccaactgctatgctcaccaacactttgtacacacccagttacacccccctgcctttattatttccagtgcagtaataacttcaacaattattgaaatgaaaatggaattaatggagttagtatcggattagcgacacgcttgccgagcttctagacggtgcgattatttcagcgggaacgactttctgtaggtgaatttaatagaggagtgttttaaatccactcgacgttgtaatagctggtttaattcgtttgtactgtcgagtagttatccaaaatcaattttggatatttaaaagaaaaaaaaacagatccgaagtattggacctactggcaaataggaattttgctatatataggtgtgcgttcatttataatggagtagcatggagttttattaatccagtaaatgttttcattgatttaattaatataacgaatttcgcttgaggccatatttgttaaacgcttttatctctatcatcattcatcctaccagtaaagagcaccggagatcgcacttcatttaaatatatgtccatgttggataaaccatagtttattatagtgttcttttatatgttttgtggggaatttagattgtttaatatggcatacatatccatccatcattattatattctaacacaactggataagtgttctaaactattgtagaataactttgtagtatgatcgatcttgtggaataaaaaaagtctgacaataacctttcataaaggaatatgaatacccgtaatcaacgcatcaaatcattcacggtgtacgcctagcgaattcgttggcgagtgctcgtgcggccgtgggctcgctgtgatgcatgcatggctctctggctacgtcgagatagcgattagtagcaaaattaagcaagccacttattaattaatctttggagatatcatatgattaaggcattaattcgtacgtactcgtcgtcagcgttttctgcaaagtccactacagttttttctttctttgctgaaaatgctgatgtgttggagatggagtgacgtgcacaacctgccgccacgtggatggttgctggagcctacgtgtcatcttaatttgaacaaaaaaaaaagaggaataatacatcaatacattttcgaatttcagttctgccattgaccagtaatacacatgtcggcctcacattttaccctgatcttagtaacgggtggtcgcctggtcggtcactgaaaaaagttcaggaaattatagtcaaactgaaacgaacatattcactccttaaaaaaactaaatctttttatatatttgtgatattgtaaaatagctacgggataatgatatagatatatatagtgataagggatagatggatcgagatatggagttgtgctttctttaatttccactacttgggctaccatattatggtagttggtatgaaaagatacacagcagtatagtgatgtgatcaatgacatgtatatctcacatgctcccatgttggagtcaaattttgctagactaaaatccaattccaagcagtccctagccaagaacaaacaaaattcagtgaggtcactgctgcaccaaggactgcatgcatgcaggagaagggcattttctcttttttcttttggagactcgattcaattcggtcggtcggtcgcaatggtcagcttaattaaa

SEQ ID NO: 45 - DNA, 2000 bp, Oryza sativa
tgtgaaaggtggcggcaccagcttagccgcagcttctctcgtcgtctccctgaaacgagagggaggaagttggtagcgtgatatatttaggcatgtcatctcttgtataagaagtcttatctgtgctaattcacacggttctctaatctctctccattctgtttttgtaaattggttcagtagatagcgtagggttatgcttatatatactccgtgaagtatatatttaaaaattagtcacacgtaaagtactatacatgttttatcgtctaataacaataaaaacactaatcataaaatttttttaaataatacgaatggttaaacgttgaatatgaaccgtgcaaaactatatttattttgtaacagagaaaatatttcacattaattagattgttgttttatggaaggttggagagctgcgccgccgttgcgcagacctaggaggctgcttataagttataatcaatcaattcacggatgccggctgggacgcggcccatcgtccgggaagacgacaactcaacgcaaaaagccgatatgcctccaaattgccattgccacctctacggctgtttatactgctccaaatcaaaagcgtccatggaagaatctagtatttcccgcaaagacgatgatgatatgcaggattggatatatagggggttgttgcatgattgctagaactcccgtttccgaagttgttcgtccatttttaaagctgccaaataggaatttattttgttttcaagtgtaatagagttctgtccagatgagtgaattataatttggttcacattttatttgctaagtttcagtttgaacattctcaaataacttttttcttcactttttaaccgagtaacttagttattttttccgtttggaccacccaacaatttgttgctaagtgcatctcacccgtcaaataattcctttgaatccaaattcaattatatcccaaaaataaaaaacttctgaattccacatcaattcaaaccccaaccattttaatttctctccatattttccatttctctatttttacctttctcttttttccatctatttatttttttccttttctatttctttctttctccttcctttctctgtttccttcttcttctcctcggctaggcccgagccagcccgtgccgcctcgcgccaaccctgtgccgccttacgccgcgcttgcgtgcgctcgcgcccacctcgtgcccaacccgcgcacgccacacgcacacacgaggacgatcgacggacgaatgcaatcatatccccttccttactcagctagaaggctcaagaaccgcaactttgatctcttccaccctctcaaatccgccccaacccctgctgactcaatcgccattaccggaggaaaaatccccgaaaccctattaccggcgccactaacagagctccaaaattcgtcgcataattcgaaaatattctgaaattgaaggtaaaaatggaatctacatgcgaagtactccctttcccctccaatccgtcactggaacgccgccggcgccgcctcccgctgccactgccctgtttggccgccgacagccgcacggcgcgccgctgctccaggccgccctagcttcaaccaccgccacctttggctccgcctccctcctcttatgctcaccaagcccgcctccctcgccggagatcgccggaaccaccgccgccatggccgccaccgcctcctgcttctggccgccgccgccagcctcgccaccggcgcctatgccaccgccgaccacggaaacggagtccctacaccttggggaccacaaaaccggcggcatccctcccaaaaccggcctcctccaccgccggcgttcgtgggattccggccagttctgtgcagagcgagagaagaagaggaaaaatagattttcctattgaaagataaatcagaaaattcctttttcttttcctatcaagttgaccatccgtttgacctcaaaatcaaaatctgagaccta

SEQ ID NO: 46 - DNA, 786 bp, Zea mays
gacatggaggtggaaggcctgacgtagatagagaagatgctcttagctttcattgtctttcttttgtagtcatctgatttacctctctcgtttatacaactggttttttaaacactccttaacttttcaaattgtctctttctttaccctagactagataattttaatggtgattttgctaatgtggcgccatgttagatagaggtaaaatgaactagttaaaagctcagagtgataaatcaggctctcaaaaattcataaactgttttttaaatatccaaatatttttacatggaaaataataaaatttagtttagtattaaaaaattcagttgaatatagttttgtcttcaaaaattatgaaactgatcttaattatttttccttaaaaccgtgctctatctttgatgtctagtttgagacgattatataattttttttgtgcttaactacgacgagctgaagtacgtagaaatactagtggagtcgtgccgcgtgtgcctgtagccactcgtacgctacagcccaagcgctagagcccaagaggccggaggtggaaggcgtcgcggcactatagccactcgccgcaagagcccaagagaccggagctggaaggatgagggtctgggtgttcacgaattgcctggaggcaggaggctcgtcgtccggagccacaggcgtggagacgtccgggataaggtgagcagccgctgcgataggggcgcgtgtgaaccccgtcgcgccccacggatggtataagaataaaggcattccgcgtgcaggatt

SEQ ID NO: 47 - DNA, 1160 bp, Zea mays
atgtgctggtgccccataaggtaggcacctaggtctgtgtttgaagcatcgacagatttgtaaacatgttcctatgaacctatttctgattgataatttgtcaaaactcatcatttgtcttcatccttgcctgcttgcgttcacgtgacaaagtacgtgtatgtcttcggcctttgctgtgtatgtttcgcattgcttagatgtggtgaaagaacatcagaagatgcattgatggcgtgcttaaaccagtgatgtgctccaggtgttcctgcagtctgcagagatatttactcttgtagtcttgttgacagcacagttgtatgtgatttcttggatgtaatgtaaaccaaatgaaagataggaacagttcgtcctcttccgtatacgaaggtcactgtatcatttgtcgtggcacaagatgatctgcaggcaggactgcaacatggtttcttggactgtcctgaatgcccgttcttgttctttagttgagccagagcagcagcctggtgtcggtgcctgagacctgacgaagcacacggcaaacaaacaagtcgcagcagctagcaggggcgttgccatcgccacaagcccccaagagacccgccgaggaaaagaaaaaaaaactacggccgccgttgccaagccgagcgtgcgaaccgatccacggatgggagatcagagatcacccaccgcaggcgggcggcagtggctggcgaggtgcgtccacagaacctgctgcaggtccctgtccgtcccggcgaccccttttctaggcgagcaactccccatggcagagctgcacgcagcagggcccgtcgttggttgcagctttaaccctttttgttttaaccatacaatgcagagtcgcagaggtgaaacaggacggaaattacagaaaagatggtggtgtgccagcagccccagcatgaagaagatcaggacaaaagaaaagcttgtgattggtgacagcaacaggattggattggagccaagctaggcagtgagaggcaggcagcaagacgcgtcagccactgaaatccagagggcaacctcggcctcacaactcatatccccttgtgctgttgcgcgccgtggttagccaggtgtgctgcaggcctcctccttgtttatatatgggagatgctctcaccctctaaggt

SEQ ID NO: 48 - DNA, 1532 bp, Oryza sativa
tagtcctctaatatatgaaattttgatataggtaaagaagggtattgcaaggataagaatgtaaaaagaaataagagtaatccttaccgataatagtattccttctctaccgttaaaagttaaacctgtgcgtgtagcattttaatccaggatctatcgaatccgtccctcgttggcgtgggcgacgaacacgtgcagaagaagctttccccagaaagcacctcaccgcctcgccgtctggcagactggcacgcggggccctaccctcgctgcgcctgggcccgtccgccttctgcacactgtcacgcccccacccgctcgccgcctcgcgcctctctctccgcctccgccgcggccgcccgacgtgatagcgacacgtaggactcgccaaacacaaaaaatccatcgcgatttttggaattttgttacaaaccaaatcccgcattagagatttaatttgatttaatttaattacgtaggagtaccagataaggagatcgagttaaaaaagctaacggcgcggcgtggttatctccgaatcggctgtggctccccgcgtcggcgtcggcgcggcggcggcgcgccggccgaaccctggccgtcggatcgggcgtcgtcctgggccccacgcgccacgggcggctgtcgtttgctcctcggagcggggtgggcccaccatggccaccaccacaggtcgcggtcgcggctgacctggcggtggtcccgtgctcgcggtgttttttttttttcactctctttctctcggtggacagtagcgggggccgcggcccgcgggggcagagattgcaaaaacagcggaaacggaagattgcaaaattgcaactgctttcctgtttttaattcgggatcaaaaagattctttcgtcggggtccccgtgccattgttgtattgcgcgtaggtccttgcttgtaaaagataatctccttaattttttctttgtactactagtgtatatgcagtaagaatataccatgagtaaaatgaaccacaaaactaattacgatataccattctcatgtagacgttctcttttcttttgctagtcatacgtgcatatataaccaaacaaaaaaatgtttgaagtactcctatccaatttattactccagtagacaacaaaagaaaatgtttgaagtaataactgatccatggtacagtagggttgtcgtcaatcttgtgtttctttcattccattgtacttacaatcgtactccagctagcacagcacaatgggcttaagctttggaccccaaattctgatcttgtcggggacccgtacgaaaatactcccgtagagatgcagataccgtcacaacctacaaccaacgaatgttaagaaaacaaagggaaaaaaaaagaggcgaattcggaggagaaaaaacggtggctaaaatatagtgcgggtgtggggacgcgacgcgagcgacgaaagaggagagaggatgggttggcctgcccccccctcccctgtctataaatgcagaggcgccgagtgccctagtcgccgctc

SEQ ID NO: 49 - DNA, 841 bp, Oryza sativa
tcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccct

SEQ ID NO: 50 - DNA, 1392 bp, Oryza sativa
ctcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgattttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacaccccggcactatcaccgtgagttgtccgcaccaccgcacgtctcgcagccaaaaaaaaaaaaagaaagaaaaaaaagaaaaagaaaaaacagcaggtgggtccgggtcgtgggggccggaaaagcgaggaggatcgcgagcagcgacgaggccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcgtccctctcctctttctttctccgttttttttttccgtctcgtctcgatctttggccttggtagtttgggggcgagaggcggcttcgtcgcccagatcggtgcgcgggaggggcgggatctcgcggctgggtctcggcgtgcggccggatcctcgcggggaatggggctctcggatgtagatctgatccgccgttgttgggggagatgatggggcgtttaaaatttcgccatgctaaacaagatcaggaagaggggaaaagggcactatggtttatatttttatatatttctgctgctgctcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagatggctgacgccgaggata

SEQ ID NO: 51 - DNA, 743 bp, Oryza sativa
gaattcccggacctccatgcctacatcaactaatttgattccttgagtttacgtttagtgatatgtctatttttagagcttgttggggcttcggcctcagctctagccagccaaacatgttctaccaagtaccctatgttggcatgatatagtgatgcattataacaataaatgagcgagggattgctggctgaaaaagctatactagctgcatttggttatagttaaccgaactattaattgcgtgtacaacaaaataaaaaaaatgcatgttgcacattctttcattaacattatgttttggtagtgtgaattagaaatttgattgacagtagatcgacaaacatagtttcaatatgcttaagttagttatgactttaacatatcagtctccttgatattttcgttttagattcgtctctctactagtgtgtatgtccaccttccatagcagtgaagggttccattccatccctggtaaaaaaaaatcaaccactactatttatttcctaaaaagcaaaatgataaaatatcatttttttaataaaaataaaaaaattttggggtacataattgatgttgccccttgggattaaccttaaaaaagggcgaattttctagggtttggccaagttttgcaatgcaccaaattattccccttgggccggccgccaccccaaaaaaaaccccaacccccaactttccattgaaggccgggcccccttaaatcctcatccccccaa

SEQ ID NO: 52 - DNA, 144 bp, Oryza sativa
taaaaaagggcgaattttctagggtttggccaagttttgcaatgcaccaaattattccccttgggccggccgccaccccaaaaaaaaccccaacccccaactttccattgaaggccgggcccccttaaatcctcatccccccaa

SEQ ID NO: 53 - DNA, 612 bp, Cauliflower mosaic virus
ggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagg

SEQ ID NO: 54 - DNA, 837 bp, Coix lacryma-jobi
agcagactcgcattatcgatggagctctaccaaactggccctaggcattaacctaccatggatcacatcgtaaaaaaaaaaccctaccatggatcctatctgttttctttttgccctgaaagagtgaagtcatcatcatatttaccatggcgcgcgtaggagcgcttcgtcgaagacccataggggggcggtactcgcaccgtggttgtttcctgttatgtaatatcggatgggggagcagtcggctaggttggtcccatcggtactggtcgtcccctagtgcgctagatgcgcgatgtttgtcctcaaaaactcttttcttcttaataacaatcatacgcaaattttttgcgtattcgagaaaaaaagaagattctatctgttttttttttgaaatggctccaatttataggaggagcccgtttaacggcgtcgacaaatctaacggacaccaaccagcgaatgagcgaacccaccagcgccaagctagccaagcgaagcagacggccgagacgctgacacccttgccttggcgcggcatctccgtcgctggctcgctggctctggccccttcgcgagagttccggtccacctccacctgtgtcggtttccaactccgttccgccttcgcgtgggacttgttccgttcatccgttggcggcatccggaaattgcgtggcgtagagcacggggccctcctctcacacggcacggaaccgtcacgagctcacggcaccggcagcacggcggggattccttccccaccaccgctccttccctttcccttcctcgcccgccatcataaatagccacccctcccagcttccttcgccacat

SEQ ID NO: 55 - DNA, 947 bp, Oryza sativa
aatccgaaaagtttctgcaccgttttcacgtcctaactaacaatatagggaacgtgtgctaaatataaaatgagaccttatatatgtagcgctgataactagaactatgtaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagatatttttttttaaaaaaaaatagaatgaagatattctgaacgtatcggcaaagatttaaacatataattatataattttatagtttgtgcattcgttatatcgcacgtcattaaggacatgtcttactccatctcaatttttatttagtaattaaagacaattgacttatttttattatttatcttttttcgattagatgcaaggtacttacgcacacactttgtgctcatgtgcatgtgtgagtgcacctcctcaatacacgttcaactagcgacacatctccaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagag

SEQ ID NO: 56 - DNA, 721 bp, Mirabilis mosaic virus
tggagattcagaaaaatctccatcaacaaataatccaagtaaggattaatggattgatcaacatccttaccgctatgggtaagattgatgaaaagtcaaaaacaaaaatcaattatgcacaccagcatgtgttgatcaccagctattgtgggacaccaatttcgtccacagacatcaacatcttatcgtcctttgaagataagataataatgttgaagataagagtgggagccaccactaaaacattgctttgtcaaaagctaaaaaagatgatgcccgacagccacttgtgtgaagcatgtgaagccggtccctccactaagaaaattagtgaagcatcttccagtggtccctccactcacagctcaatcagtgagcaacaggacgaaggaaatgacgtaagccatgacgtctaatcccacaagaatttccttatataaggaacacaaatcagaaggaagagatcaatcgaaatcaaaatcggaatcgaaatcaaaatcggaatcgaaatctctcatctctctctaccttctctctaaaaaacacttagatgtgtgagtaatcacccacttggggttgtaatatgtagtagtaaataagggaaccttagggtataccattgttgtaatattattttcagtatcaataaaataatctttcagtttatcttatattcatttgtgtgacaccgtattcccataaaaccgatcctaatctctcc

SEQ ID NO: 57 - DNA, 352 bp, Peanut chlorotic streak virus
acagagggatttctctgaagatcatgtttgccagctatgcgaacaatcatcgggagatcttgagccaatcaaagaggagtgatgtagacctaaagcaataatggagccatgacgtaagggcttacgccattacgaaataattaaaggctgatgtgacctgtcggtctctcagaacctttactttttatatttggcgtgtatttttaaatttccacggcaatgacgatgtgacctgtgcatccgctttgcctataaataagttttagtttgtattgatcgacacgatcgagaagacacggccatttggacgatcatttgagagtctaaaagaacgagtcttgtaatatgtttt

SEQ ID NO: 58 - DNA, 7139 bp, Zea mays
gctctgccactctgctgaggtggggggagaggagctccccctccctcctctcccctcctcgccatgtctagcagcgacccggaggagatcagggcgcgcgtcgtcgttctcggttcgccccatgccgacggcggcgacgagtgggcccggcccgagctcgaggccttccatctgccgtctcccgcccaccagcctcctggcttcctagccgggcaaccggaagcagcagagcaacccacgctccctgctcctgctggccgcagcagcagcagcagcaacacgcctactacatctgccggtggcggcgctgctcctcctcctccttcttcgcctccccctccgccggcttctctggagaccgagcagccgcccaatgccaggccagcctccgccggcgccaatgacagcaagaagcccaccccgcccgccgccctgcgcgacctcttccgcttcgccgacggcctcgactgcgcgctcatgctcatcggcaccctcggcgcgctcgtccacgggtgctcgctccccgtcttcctccgcttcttcgccgacctcgtcgactccttcggctcccacgccgacgacccggacaccatggtccgcctcgtcgtcaagtacgccttctacttcctcgtcgtcggagcggcaatctgggcatcctcgtgggcaggtacgctatccctcctcctcctgccgccccagcttgtgtgcgtcgcgaattggcggtcaatttggattggatgacaaatcacgtcggtcagccaatcgccgtggctacaaacgagatgttcaaatcgttcgccccgctcgcaagagatctcttgctggatgtggaccggcgagcggcagtcgacgcggatgcggattcggtacctggacgcggcgctgcggcaggacgtgtccttcttcgacaccgacgtgcgggcctcggacgtgatctacgccatcaacgcggacgccgtggtggtgcaggacgccatcagccagaaactgggcaacctcatccactacatggccaccttcgtggccggcttcgtcgtggggttcacggccgcgtggcagctggcgctggtcacgctggccgtggtgccgctcatcgccgtcatcggcgggctgagcgccgccgcgctcgccaagctctcgtcccgcagccaggacgcgctctcgggcgccagcggcatcgcggagcaggcgctcgcgcagatacggatcgtgcaggcgttcgttggcgaggagcgcgagatgcgggcctactcggcggcgctggccgtggcgcagaggatcggctaccgcagcggcttcgccaaggggctcggcctcggcggcacctacttcaccgtcttctgctgctacgggctcctgctctggtacggcggccacctcgtgcgcgcccagcacaccaacggcgggctcgccatcgccaccatgttctccgtcatgatcggcggactgtaaggcccaccacaccacgcactctctccttctgctgtcctcggccgcccccgtcgtcattgctgctgacggtatctgtggatcgcgtgcaggcctcggcagtcggcgccgagcatggccgcgttcgccaaggcgcgtgtggcggctgccaagatcttccgcatcatcgaccacaggccgggcatctcctcgcgcgacggcgcggagccagagtcggtgacggggcgggtggagatgcggggcgtggacttcgcgtacccgtcgcggccggacgtccccatcctgcgcggcttctcgctgagcgtgcccgccgggaagaccatcgcgctggtgggcagctccggctccgggaagagcacggtggtgtcgctcatcgagagattctacgaccccagcgcaggtatacctagtactgttactacttttagcgcattaatctgaggatgtccagttcgcttgcttgccaatcgccattgccatcgcaacaacaatacttcgccaactgccattgctgggtagattagtacagtagcagttagaagaagcctccactgtacattgcattgccaaacaaaagtgaattgtgcagtaactctgtaccaccacattgacatggaaatgaagtgaatgcttggagcatgcagagctggccggcctcatgggctgctgctacctgctagctagccaaccagaaccagccatcctctttcttgcttttctttttactttctttggtcgtggctgtttgtggtcatacatacattcacgcagagcagaagagctagctaagctaggtgggtgtgcctgcaacgcgggacaaagaaaactatttgttgcctggcaagatgctactgttgcctagcacatgcctgccattgaccgactgctcagtgagaagtggttcagttgtgctgttgacagtatagatagatatatatagtagccctgtagatttttttttcagacaaaaaaagaagaagaacgagatgaagtctgcaattcggttttggcagggcaaatcctgctggacgggcacgacctcaggtcgctggagctgcggtggctgcggcggcagatcgggctggtgagccaggagccggcgctgttcgcgacgagcatcagggagaacctgctgctggggcgggacagccagagcgcgacgctggcggagatggaggaggcggccagggtggccaacgcccactccttcatcatcaaactccccgacggctacgacacgcaggtccgtcccgtatagctagctcactagctgcactgccacttctctcgcttgctcccccaccgttgctgcctgttgctctccaatccacttgtcggtgtctggaccacacgtgctgcttgcctagctgctccacatctgctttccctgtccaaccttatgcaactcactctaatactatatcaaatacatttctagagtttaaagcttatcttagaataaatgcatctttagctacgagacaacctaacttcagttgttgttgttgttttttttactttctctcttctcacaaatactatgattacgtctttacagcgatcttttttattccaaacctaaaaatgcatgcactcactctaaaagcgcaaagggagcatctttttttcccccatcatctgcacgcagccttttcttttcctcatgtcacgaagggactgaaggtgtgtatgcagcgtcaagtcatccatccgttccactccactcactcatgcgtcgcgcactctgcgctcgtgcctgcccggggctaaagctttagtagctagcctcagatcagatactgttcgtgtttgttaggccgcggcagctgcacatgagctcatgacagccggcagcaccaccaccaacgccatggaagaggggtcggggtccatcacatagacataatgcctgttgtagactaggacgggagggcaattgttaggcgcctgttgccatcgcatttgctgctgtgggttgccaacaagtaacatgccaggatgctttgctatcacgcacaggacaggagaggtcctttttctcgacacaagctctacagcctctactaaactagcacttgctgatgagtgcagaggatgaatggacgatgaacatctagagtgagagagaaaaaaatgttaataataataaaaagtagtagcaggattaagaatcaacctggggtacgtaggaagaggtacaatccctaggaatctagagtatgagaagtatgggaggagttgggggagtgaaacggaacaaattccgagttggtattttgtcgggaatgtcaagttgatttttgatcctagtgcaagcaagaattatcaatcactcagactcagcctgtctgtgtctgtccaccccagctcttgctactctacttactactgtgctactagtgggtagggtaggtatcttacataaactgttattataaactgtcatctgagaaagagagccagtcaaacccatgctgctgcttattttaatcactgtcaaatggcaggcaggcaggcagtctggttagttaataacatctgggaagggtttaatcaaaccaaatcaaatcagacgaaatctagaggccacatgggatggggccatatgtactgtactagcataactagcggctagattttattagaacacggactcacactcccataactataactgacttgatcatgattccttgccaagcaatgctcgcatgcccatgcatgcatcatccctggtcaaactcaaacactctccaccgtcagggaataagacttattattttattaacaattcaatttttatttattaattacgtctggacgaggagtactggtttatttgatgagagacatggcagtccaagtcaaactcgtttgtctgaccatggcggtgatggccggtgcaggttggggagcgcggcctgcagctctccggtgggcagaagcagcgcatcgccatcgcccgcgccatgctcaagaaccccgccatcctgctgctggacgaggccaccagcgcgctggactccgagtctgagaagctcgtgcaggaggcgctggaccgcttcatgatggggcgcaccacccttggtgatcgcgcaacaggctgtccaccatccgcaaaggccgacgtggtggccgtgctgcagggcggcgccgtctccgagatgagcgcgcacgacgagctgatggccaagggcgagaacggcacctacgccaagctcatccgcatgcaggagcaggcgcacgaggcggcgctcgtcaacgcccgccgcagcagcgccaggccctccagcgcccgcaactccgtcagctcgcccatcatgacgcgcaactcctcctacggccgctccccctactcccgccgcctctccgacttctccacctccgacttcaccctctccatccacgacccgcaccaccaccaccggaccatggcggacaagcagctggcgttccgcgccggcgccagctccttcctgcgcctcgccaggatgaactcgcccgagtgggcctacgcgctcgccggctccatcggctccatggtctgcggctccttcagcgccatcttcgcctacatcctcagcgccgtgctcagcgtctactacgcgccggacccgcggtacatgaagcgcgagatcgcaaaatactgttacctgctcatcggcatgtcctccgcggcgctgctgttcaacacggtgcagcacgtgttctgggacacggtgggcgagaacttgaccaagcgggtgcgcgagaagatgttcgccgccgtgttccgcaacgagatcgcctggttcgacgcggacgagaacgccagcgcgcgcgtgaccgccaggctagcgctggacgcccagaacgtgcgctccgccatcggggaccgcatctccgtcatcgtccagaactcggcgctgatgctggtggcctgcaccgcggggttcgtcctccagtggcgcctcgcgctcgtgctcctcgccgtgttcccgctcgtcgtgggcgccaccgtgctgcagaagatgttcatgaagggcttctcgggggacctggaggccgcgcacgccagggccacgcagatcgcgggcgaggccgtggccaacctgcgcaccgtggccgcgttcaacgcggagcgcaagatcacggggctgttcgaggccaacctgcgcggcccgctccggcgctgcttctggaaggggcagatcgccggcagcggctacggcgtggcgcagttcctgctgtacgcgtcctacgcgctggggctgtggtacgcggcgtggctggtgaagcacggcgtgtccgacttctcgcgcaccatccgcgtgttcatggtgctgatggtgtccgcgaacggcgccgccgagacgctgacgctggcgccggacttcatcaaaggcgggcgcgcgatgcggtcggtgttcgagacaatcgaccgcaagacggaggtggagccccacgacgtggacgcggcgccggtgccggacggcccaggggcgaaggtggaacttaagcacgtggactttttgtacccgtcgcggccggacatccaagtgttccgcgacctgagcctccgtgcgcgcgccggaaaaacgttggcgctggtggggccgagcgggtccggcaagagctcggtcctggctctggtgcagcggttctacaagcccacgtccgggcgcgtgctcttggacggcaaggacgtgcgcaagtacaacctgcgggcgctgcggcgcgtggtggcggtggtaccgcaggagccgttcctgttcgcggcgagcatccacgagaacatcgcgtacgggcgcgagggcgcgacggaggcggaggtggtggaggcggcggcgcaggcgaacgcgcaccggttcatcgcggcgctgccggaggggtaccggacgcaggtgggcgagcgcggggtgcagctgtcgggggggcagcggcagcggatcgcgatcgcgcgcgcgctggtgaagcaggcggccatcgtgctgctggacgaggcgaccagcgcgctggacgccgagtcggagcggtgcgtgcaggaggcgctggagcgcgcggggtccgggcgcaccaccatcgtggtggcgcaccggctggccacggtgcgcggcgcgcacaccatcgcggtcatcgacgacggcaaggtggcggagcaggggtcgcactcgcacctgctcaagcaccatcccgacgggtgctacgcgcggatgctgcagcttgcagcggctgacgggcgcggcggccgggcccgggccgtcgtcctcgtgcaacggggccgcgtaggacggaatggatggatggatgggtttggttcctcgagagattgatgggtgaggaagctgaagctccggatcaaatggtggtactccatgatcgcaacaatgaggggaaaaaaggaaaggagaaaatacggtggttcatatgattgtacaatttgacgatctgtttgagtcggggttttaggatgatgtaaaccttcactcgccttttttttactcttgtttctcatccgcatcagtatcatctatctacatacagtgtcagagatgggaactgatcccgcatcatcatctacctcccaaggcaccccagattgtattaatgtacttagttagcctgttttatatatacttataagtaccaaatagcagaattttactccttatctgcagtagcacgaaagaaaaaaaaaaaaagctaaacct

SEQ ID NO: 59 - DNA, 143 bp, Zea mays
ttgcctagcacatgcctgccattgaccgactgctcagtgagaagtggttcagttgtgctgttgacagtatatatagatatatatagtagccctgtagatttttttttcagacaaaaaaagaagaagaacgagatgaagtctgc

SEQ ID NO: 60 - DNA, 143 bp, Zea mays
ctagcacatgcctgccattgaccgactgctcagtgagaagtggttcagttgtgctgttgacagtatagatatatatatatagtagccctgtagatttttttttcagacaaaaaaagaagaagaacgagatgaagtctgcaatt

SEQ ID NO: 61 - DNA, 143 bp, Zea mays
acatgcctgccattgaccgactgctcagtgagaagtggttcagttgtgctgttgacagtatagatagatatgtatagtagccctgtagatttttttttcagacaaaaaaagaagaagaacgagatgaagtctgcaattcggtt

SEQ ID NO: 62 - DNA, 142 bp, Zea mays
catgcctgccattgaccgactgctcagtgagaagtggttcagttgtgctgttgacagtatagatagatatagtagccctgtagatttttttttcagacaaaaaaagaagaagaacgagatgaagtctgcaattcggttttgg

SEQ ID NO: 63 - DNA, 140 bp, Zea mays
gctgttgacagtatagatagatatatatagtagccctgtagatttttttttcagacaaaaaaagaagaacgagatgaagtctgcaattcggttttggcagggcaaatcctgctggacgggcacgacctcaggtcgctgga

SEQ ID NO: 64 - DNA, 141 bp, Zea mays
tgacagtatagatagatatatatagtagccctgtagatttttttttcagacaaaaaaagaagaagaacgggatgaagtctgcaattcggttttggcagggcaaatcctgctggacgggcacgacctcaggtcgctggagct

SEQ ID NO: 65 - DNA, 141 bp, Zea mays; identical to SEQ ID NO: 64

SEQ ID NO: 66 - DNA, 144 bp, Zea mays
aggcggccagggtggccaacgcccactccttcatcatcaaactccccgacggctacgacacgcaggtccgtgtccgtcccgtatagctagctcactagctgcactgccacttctctcgcttgctcccccaccgttgctgcctgt

SEQ ID NO: 67 - DNA, 136 bp, Zea mays
caacgcccactccttcatcatcaaactccccgacggctacgacacgcaggtccgtcccgtatagcggtagctcactagctgcactgccacttctctcgcttgctcccccaccgttgctgcctgttgctctccaatc

SEQ ID NO: 68 - DNA, 136 bp, Zea mays
gcccactccttcatcatcaaactccccgacggctacgacacgcaggtccgtcccgtatagctatagctcactagctgcactgccacttctctcgcttgctcccccaccgttgctgcctgttgctctccaatccact

SEQ ID NO: 69 - DNA, 133 bp, Zea mays
ctccttcatcatcaaactccccgacggctacgacacgcaggtccgtcccgtatagctagctaactagctgcactgccacttctctcgcttgctcccccaccgttgctgcctgttgctctccaatccacttgtc

SEQ ID NO: 70 - DNA, 141 bp, Zea mays
cacacgcacacacacagatcgcctgacaagccagccattgcttcagatcaaagaaactgcgtaataatttctttctttctttctttctttctttccagagcacaagggaggggggttataatggctagtacctgactgact

SEQ ID NO: 71 - DNA, 143 bp, Zea mays
agccagccattgcttcagatcaaagaaactgcgtaataattcctttctttctttctttctttctttccagatcacaagggaggggggttataatggctagtacctgactgactgtacgagccgagattaacggcagtcacctc

SEQ ID NO: 72 - DNA, 143 bp, Zea mays
atcgccctgctggccatttggcaccacctagtcgtacatgtgttcagtcatttccgtccattactactacggccgtgctcacccgtgccgacgcgccgtgcatggtccccgtcccggctggaacgcgtcctcggaagagagag

SEQ ID NO: 73 - DNA, 143 bp, Zea mays
ccattactactacgaccgtgctcacccgtgccgacgcgccgtgcatggtccccgtcccggctggaacgcgtgctcggaagagagagatagagcacagcagacagggagacagggatggaaggatggcgttcgcccggtacagg

SEQ ID NO: 74 - DNA, 143 bp, Zea mays
cattactactacgaccgtgctcacccgtgccgacgcgccgtgcatggtccccgtcccggctggaacgcgtcatcggaagagagagatagagcacagcagacagggagacagggatggaaggatggcgttcgcccggtacaggt

SEQ ID NO: 75 - DNA, 143 bp, Zea mays
attactactacgaccgtgctcacccgtgccgacgcgccgtgcatggtccccgtcccggctggaacgcgtccccggaagagagagatagagcacagcagacagggagacagggatggaaggatggcgttcgcccggtacaggtt

SEQ ID NO: 76 - DNA, 143 bp, Zea mays
ttactactacgaccgtgctcacccgtgccgacgcgccgtgcatggtccccgtcccggctggaacgcgtcctgggaagagagagatagagcacagcagacagggagacagggatggaaggatggcgttcgcccggtacaggttg

SEQ ID NO: 77 - DNA, 143 bp, Zea mays
tactactacgaccgtgctcacccgtgccgacgcgccgtgcatggtccccgtcccggctggaacgcgtcctccgaagagagagatagagcacagcagacagggagacagggatggaaggatggcgttcgcccggtacaggttgc

SEQ ID NO: 78 - DNA, 143 bp, Zea mays
ctactacgaccgtgctcacccgtgccgacgcgccgtgcatggtccccgtcccggctggaacgcgtcctcggtagagagagatagagcacagcagacagggagacagggatggaaggatggcgttcgcccggtacaggttgcta

SEQ ID NO: 79 - DNA, 143 bp, Zea mays
tactacgaccgtgctcacccgtgccgacgcgccgtgcatggtccccgtcccggctggaacgcgtcctcggacgagagagatagagcacagcagacagggagacagggatggaaggatggcgttcgcccggtacaggttgctag

SEQ ID NO: 80 - DNA, 146 bp, Zea mays
actacgaccgtgctcacccgtgccgacgcgccgtgcatggtccccgtcccggctggaacgcgtcctcggaactcggagagagatagagcacagcagacagggagacagggatggaaggatggcgttcgcccggtacaggttgctag

SEQ ID NO: 81 - DNA, 143 bp, Zea mays
caggaggcgctggaccgcttcatgatcgggcgcaccaccctggtgatcgcgcacaggctgtccaccatccgcaaggccgacgtggtggccgtgctgcagggcggcgccgtctccgagatgggcgcgcacgacgagctgatggc

SEQ ID NO: 82 - DNA, 143 bp, Zea mays
tccatcggctccatggtctgcggctccttcagcgccatcttcgcctacatcctcagcgccgtgctcagcgtctactacgcgccggacccgcggtacatgaagcgcgagatcgcaaaatactgctacctgctcatcggcatgtc

SEQ ID NO: 83 - DNA, 143 bp, Zea mays
gcctacatcctcagcgccgtgctcagcgtctactacgcgccggacccgcggtacatgaagcgcgagatcgcaaaatactgctacctgctcatcggcatgtcctccgcggcgctgctgttcaacacggtgcagcacgtgttctg

SEQ ID NO: 84 - DNA, 143 bp, Zea mays
ctggttcgacgcggacgagaacgccagcgcgcgcgtggccgccaggctagcgctggacgcccagaacgtgcgctccgccatcggggaccgcatctccgtcatcgtccagaactcggcgctgatgctggtggcctgcaccgcgg

SEQ ID NO: 85 - DNA, 143 bp, Zea mays
cagaacgtgcgctccgccatcggggaccgcatctccgtcatcgtccagaactcggcgctgatgctggtggcctgcaccgcggggttcgtcctccagtggcgcctcgcgctcgtgctcctcgccgtgttcccgctcgtcgtggg

SEQ ID NO: 86 - DNA, 143 bp, Zea mays
  modified_base (72)..(72): a, c, t, g, or absent
  See specification as filed for detailed description of substitutions and preferred embodiments
ttgcctagcacatgcctgccattgaccgactgctcagtgagaagtggttcagttgtgctgttgacagtatanatagatatatatagtagccctgtagatttttttttcagacaaaaaaagaagaagaacgagatgaagtctgc

SEQ ID NO: 87 - DNA, 143 bp, Zea mays
  modified_base (72)..(72): a, c, t, g, or absent
  See specification as filed for detailed description of substitutions and preferred embodiments
ctagcacatgcctgccattgaccgactgctcagtgagaagtggttcagttgtgctgttgacagtatagatanatatatatagtagccctgtagatttttttttcagacaaaaaaagaagaagaacgagatgaagtctgcaatt

SEQ ID NO: 88 - DNA, 143 bp, Zea mays
  modified_base (72)..(72): a, c, t, g, or absent
  See specification as filed for detailed description of substitutions and preferred embodiments
acatgcctgccattgaccgactgctcagtgagaagtggttcagttgtgctgttgacagtatagatagatatntatagtagccctgtagatttttttttcagacaaaaaaagaagaagaacgagatgaagtctgcaattcggtt

SEQ ID NO: 89 - DNA, 146 bp, Zea mays
  modified_base (72)..(75): a, c, t, g, or absent
  See specification as filed for detailed description of substitutions and preferred embodiments
catgcctgccattgaccgactgctcagtgagaagtggttcagttgtgctgttgacagtatagatagatatannnngtagccctgtagatttttttttcagacaaaaaaagaagaagaacgagatgaagtctgcaattcggttttgg

SEQ ID NO: 90 - DNA, 143 bp, Zea mays
  modified_base (70)..(72): a, c, t, g, or absent
  See specification as filed for detailed description of substitutions and preferred embodiments
gctgttgacagtatagatagatatatatagtagccctgtagatttttttttcagacaaaaaaagaagaannncgagatgaagtctgcaattcggttttggcagggcaaatcctgctggacgggcacgacctcaggtcgctgga

SEQ ID NO: 91 - DNA, 141 bp, Zea mays
  modified_base (70)..(70): a, c, t, g, or absent
  See specification as filed for detailed description of substitutions and preferred embodiments
tgacagtatagatagatatatatagtagccctgtagatttttttttcagacaaaaaaagaagaagaacgngatgaagtctgcaattcggttttggcagggcaaatcctgctggacgggcacgacctcaggtcgctggagct

SEQ ID NO: 92 - DNA, 143 bp, Zea mays
  modified_base (72)..(72): a, c, t, g, or absent
  See specification as filed for detailed description of substitutions and preferred embodiments
tttttttttcagacaaaaaaagaagaagaacgagatgaagtctgcaattcggttttggcagggcaaatcctnctggacgggcacgacctcaggtcgctggagctgcggtggctgcggcggcagatcgggctggtgagccagga

SEQ ID NO: 93 - DNA, 144 bp, Zea mays
  modified_base (72)..(77): a, c, t, g, or absent
  See specification as filed for detailed description of substitutions and preferred embodiments
aggcggccagggtggccaacgcccactccttcatcatcaaactccccgacggctacgacacgcaggtccgtnnnnnncccgtatagctagctcactagctgcactgccacttctctcgcttgctcccccaccgttgctgcctgt

SEQ ID NO: 94 - DNA, 136 bp, Zea mays
  modified_base (66)..(67): a, c, t, g, or absent
  See specification as filed for detailed description of substitutions and preferred embodiments
caacgcccactccttcatcatcaaactccccgacggctacgacacgcaggtccgtcccgtatagcnntagctcactagctgcactgccacttctctcgcttgctcccccaccgttgctgcctgttgctctccaatc

SEQ ID NO: 95 - DNA, 136 bp, Zea mays
  modified_base (64)..(65): a, c, t, g, or absent
  See specification as filed for detailed description of substitutions and preferred embodiments
gcccactccttcatcatcaaactccccgacggctacgacacgcaggtccgtcccgtatagctanngctcactagctgcactgccacttctctcgcttgctcccccaccgttgctgcctgttgctctccaatccact

SEQ ID NO: 96 - DNA, 133 bp, Zea mays
  modified_base (62)..(62): a, c, t, g, or absent
  See specification as filed for detailed description of substitutions and preferred embodiments
ctccttcatcatcaaactccccgacggctacgacacgcaggtccgtcccgtatagctagctnactagctgcactgccacttctctcgcttgctcccccaccgttgctgcctgttgctctccaatccacttgtc

SEQ ID NO: 97 - DNA, 141 bp, Zea mays
  modified_base (70)..(70): a, c, t, g, or absent
  See specification as filed for detailed description of substitutions and preferred embodiments
cacacgcacacacacagatcgcctgacaagccagccattgcttcagatcaaagaaactgcgtaataattnctttctttctttctttctttctttccagagcacaagggaggggggttataatggctagtacctgactgact

SEQ ID NO: 98 - DNA, 143 bp, Zea mays
  modified_base (72)..(72): a, c, t, g, or absent
  See specification as filed for detailed description of substitutions and preferred embodiments
agccagccattgcttcagatcaaagaaactgcgtaataattcctttctttctttctttctttctttccagancacaagggaggggggttataatggctagtacctgactgactgtacgagccgagattaacggcagtcacctc

SEQ ID NO: 99 - DNA, 143 bp, Zea mays
  modified_base (72)..(72): a, c, t, g, or absent
  See specification as filed for detailed description of substitutions and preferred embodiments
atcgccctgctggccatttggcaccacctagtcgtacatgtgttcagtcatttccgtccattactactacgnccgtgctcacccgtgccgacgcgccgtgcatggtccccgtcccggctggaacgcgtcctcggaagagagag

SEQ ID NO: 100 - DNA, 143 bp, Zea mays
  modified_base (72)..(72): a, c, t, g, or absent
  See specification as filed for detailed description of substitutions and preferred embodiments
ccattactactacgaccgtgctcacccgtgccgacgcgccgtgcatggtccccgtcccggctggaacgcgtnctcggaagagagagatagagcacagcagacagggagacagggatggaaggatggcgttcgcccggtacagg

SEQ ID NO: 101 - DNA, 143 bp, Zea mays
  modified_base (72)..(72): a, c, t, g, or absent
  See specification as filed for detailed description of substitutions and preferred embodiments
cattactactacgaccgtgctcacccgtgccgacgcgccgtgcatggtccccgtcccggctggaacgcgtcntcggaagagagagatagagcacagcagacagggagacagggatggaaggatggcgttcgcccggtacaggt

SEQ ID NO: 102 - DNA, 143 bp, Zea mays
  modified_base (72)..(72): a, c, t, g, or absent
  See specification as filed for detailed description of substitutions and preferred embodiments
attactactacgaccgtgctcacccgtgccgacgcgccgtgcatggtccccgtcccggctggaacgcgtccncggaagagagagatagagcacagcagacagggagacagggatggaaggatggcgttcgcccggtacaggtt

SEQ ID NO: 103 - DNA, 143 bp, Zea mays
  modified_base (72)..(72): a, c, t, g, or absent
  See specification as filed for detailed description of substitutions and preferred embodiments
ttactactacgaccgtgctcacccgtgccgacgcgccgtgcatggtccccgtcccggctggaacgcgtcctnggaagagagagatagagcacagcagacagggagacagggatggaaggatggcgttcgcccggtacaggttg

SEQ ID NO: 104 - DNA, 143 bp, Zea mays; identical to SEQ ID NO: 103
  modified_base (72)..(72): a, c, t, g, or absent
  See specification as filed for detailed description of substitutions and preferred embodiments

SEQ ID NO: 105 - DNA, 143 bp, Zea mays
  modified_base (72)..(72): a, c, t, g, or absent
  See specification as filed for detailed description of substitutions and preferred embodiments
ctactacgaccgtgctcacccgtgccgacgcgccgtgcatggtccccgtcccggctggaacgcgtcctcggnagagagagatagagcacagcagacagggagacagggatggaaggatggcgttcgcccggtacaggttgcta

SEQ ID NO: 106 - DNA, 143 bp, Zea mays
  modified_base (72)..(72): a, c, t, g, or absent
  See specification as filed for detailed description of substitutions and preferred embodiments
tactacgaccgtgctcacccgtgccgacgcgccgtgcatggtccccgtcccggctggaacgcgtcctcggangagagagatagagcacagcagacagggagacagggatggaaggatggcgttcgcccggtacaggttgctag

SEQ ID NO: 107 - DNA, 146 bp, Zea mays
  modified_base (72)..(75): a, c, t, g, or absent
  See specification as filed for detailed description of substitutions and preferred embodiments
actacgaccgtgctcacccgtgccgacgcgccgtgcatggtccccgtcccggctggaacgcgtcctcggaannnngagagagatagagcacagcagacagggagacagggatggaaggatggcgttcgcccggtacaggttgctag

SEQ ID NO: 108 - DNA, 143 bp, Zea mays
  modified_base (72)..(77): a, c, t, g, or absent
  See specification as filed for detailed description of substitutions and preferred embodiments
ttgcctagcacatgcctgccattgaccgactgctcagtgagaagtggttcagttgtgctgttgacagtatannnnnntatatatagtagccctgtagatttttttttcagacaaaaaaagaagaagaacgagatgaagtctgc

SEQ ID NO: 109 - DNA, 148 bp, Zea mays
  modified_base (76)..(77): a, c, t, g, or absent
  See specification as filed for detailed description of substitutions and preferred embodiments
catgcctgccattgaccgactgctcagtgagaagtggttcagttgtgctgttgacagtatagatagatatatatanngtagccctgtagatttttttttcagacaaaaaaagaagaagaacgagatgaagtctgcaattcggttttgg

SEQ ID NO: 110 - DNA, 142 bp, Zea mays
  modified_base (66)..(69): a, c, t, g, or absent
  See specification as filed for detailed description of substitutions and preferred embodiments
caacgcccactccttcatcatcaaactccccgacggctacgacacgcaggtccgtcccgtatagcnnnntagctcactagctgcactgccacttctctcgcttgctcccccaccgttgctgcctgttgctctccaatccact

SEQ ID NO: 111 - DNA, 146 bp, Zea mays
  modified_base (71)..(76): a, c, t, g, or absent
  See specification as filed for detailed description of substitutions and preferred embodiments
tttctagagtttaaagcttatcttagaataaatgcatctttagctacgagacaacctaacttcagttgttnnnnnngttttttttactttctctcttctcacaaatactatgattacgtctttacagcgatcttttttattccaaa

SEQ ID NO: 112 - DNA, 146 bp, Zea mays
  modified_base (77)..(77): a, c, t, g, or absent
  See specification as filed for detailed description of substitutions and preferred embodiments
tttctagagtttaaagcttatcttagaataaatgcatctttagctacgagacaacctaacttcagttgttgttgttnttttttttactttctctcttctcacaaatactatgattacgtctttacagcgatcttttttattccaaa

SEQ ID NO: 113 - DNA, 105 bp, Zea mays
  modified_base (60)..(61): a, c, t, g, or absent
  See specification as filed for detailed description of substitutions and preferred embodiments
attccaaacctaaaaatgcatgcactcactctaaaagcgcaaagggagcatctttttttnncccccatcatctgcacgcagccttttcttttcctcatgtcacga

SEQ ID NO: 114 - DNA, 181 bp, Zea mays
  modified_base (63)..(111): a, c, t, g, or absent
  See specification as filed for detailed description of substitutions and preferred embodiments
tcggtgctggctctggtgcagcggttctacgagcccacgtccgggcgcgtgctcctggacggnnnnnnnnnnnnnnnnnnnnnnnnnnnnnnnnnnnnnnnnnnnnnnnnncaaggacgtgcgcaagtacaacctgcgggcgctgcggcgcgtggtggcggtggtaccgcaggagccgttc

SEQ ID NO: 115 - DNA, 185 bp, Zea mays
  modified_base (51)..(135): a, c, t, g, or absent
  See specification as filed for detailed description of substitutions and preferred embodiments
agaacacggactcacactcccataactataactgacttgatcatgattccnnnnnnnnnnnnnnnnnnnnnnnnnnnnnnnnnnnnnnnnnnnnnnnnnnnnnnnnnnnnnnnnnnnnnnnnnnnnnnnnnnnnnattttattaacaattcaatttttatttattaattacgtctggacgaggag

SEQ ID NO: 116 - DNA, 140 bp, Zea mays
  modified_base (52)..(69): a, c, t, g, or absent
  See specification as filed for detailed description of substitutions and preferred embodiments
ccaccgtcagggaataagacttattattttattaacaattcaatttttattnnnnnnnnnnnnnnnnnntattaattacgtctggacgaggagtactggtttatttgatgagagacatggcagtccaagtcaaactcgtt

SEQ ID NO: 117 - DNA, 711 bp, Zea mays
  modified_base (66)..(644): a, c, t, g, or absent
  See specification as filed for detailed description of substitutions and preferred embodiments
actgaaggtgtgtatgcagcgtcaagtcatccatccgttccactccactcactcatgcgtcgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctgcgctcgtgcctgcccggggctaaagctttagtagctagcctcagatcagatactgttcgtg

SEQ ID NO: 118 - DNA, 114 bp, Zea mays
  modified_base (68)..(80): a, c, t, g, or absent
  See specification as filed for detailed description of substitutions and preferred embodiments
gcactcaggactcgcagcgagagaatttttttaatcaagcctaaaattcactttcggacaaatcgaannnnnnnnnnnnnctactcataaatattaaccatgagaccttttcgc

SEQ ID NO: 119 - DNA, 141 bp, Zea mays
  modified_base (71)..(71): a, c, t, g, or absent
  See specification as filed for detailed description of substitutions and preferred embodiments
ttagcgcattaatctgaggatgtccagttcgcttgcttgccaatcgccattgccatcgcaacaacaatacntcgccaactgccattgctgggtagactagtacagtagcagttagaagaagcctccactgtacattgcatt

SEQ ID NO: 120 - DNA, 141 bp, Zea mays
  modified_base (73)..(73): a, c, t, g, or absent
  See specification as filed for detailed description of substitutions and preferred embodiments
ttagcgcattaatctgaggatgtccagttcgcttgcttgccaatcgccattgccatcgcaacaacaatacttngccaactgccattgctgggtagactagtacagtagcagttagaagaagcctccactgtacattgcatt

SEQ ID NO: 121 - DNA, 144 bp, Zea mays
  modified_base (72)..(73): a, c, t, g, or absent
  See specification as filed for detailed description of substitutions and preferred embodiments
ccatcctctttcttgcttttctttttactttctttggtcgtggctgtttgtggtcatacatacattcacgcnnagagcagaagagctagctaagctaggtgggtgtgcctgcaacgcgggacaaagaaaactatttgttgcctg

SEQ ID NO: 122 - DNA, 138 bp, Zea mays
  modified_base (70)..(70): a, c, t, g, or absent
  See specification as filed for detailed description of substitutions and preferred embodiments
tgtgtctgtccaccccagctcttgctactctacttactactgtgctactagtggtagggtaggtatcttncataaactgttattataaactgtcatctgagaaagagagccagtcaaacccatgctgctgcttatttt

SEQ ID NO: 123 - DNA, 142 bp, Zea mays
  modified_base (70)..(70): a, c, t, g, or absent
  See specification as filed for detailed description of substitutions and preferred embodiments
tcttacataaactgttattataaactgtcatctgagaaagagagccagtcaaacccatgctgctgcttanttttaatcactgtcaaatggcaggcaggcaggcagtctggttagttaataacatctgggaagggtttaatca

SEQ ID NO: 124 - DNA, 141 bp, Zea mays
  modified_base (70)..(70): a, c, t, g, or absent
  See specification as filed for detailed description of substitutions and preferred embodiments
ggcaggcaggcaggcagtctggttagttaataacatctgggaagggtttaatcaaaccaaatcaaatcanacgaaatctagaggccacatgggatggggccatatgtactgtactagcataactagcggctagattttatt

SEQ ID NO: 125 - DNA, 141 bp, Zea mays
  modified_base (71)..(71): a, c, t, g, or absent
  See specification as filed for detailed description of substitutions and preferred embodiments
caaaccaaatcaaatcagacgaaatctagaggccacatgggatggggccatatgtactgtactagcataantagcggctagattttattagaacacggactcacactcccataactataactgacttgatcatgattcctt

SEQ ID NO: 126 - DNA, 143 bp, Zea mays
  modified_base (72)..(72): a, c, t, g, or absent
  See specification as filed for detailed description of substitutions and preferred embodiments
tactgtactagcataactagcggctagattttattagaacacggactcacactcccataactataactgacnttgatcatgattccttgccaagcaatgctcgcatgcccatgcatgcatcatccctggtcaaactcaaacac

SEQ ID NO: 127 - DNA, 141 bp, Zea mays
  modified_base (71)..(71): a, c, t, g, or absent
  See specification as filed for detailed description of substitutions and preferred embodiments
catcatccctggtcaaactcaaacactctccaccgtcagggaataagacttattattttattaacaattcnatttttatttattaattacgtctggacgaggagtactggtttatttgatgagagacatggcagtccaagt

SEQ ID NO: 128 - DNA, 141 bp, Zea mays
  modified_base (71)..(71): a, c, t, g, or absent
  See specification as filed for detailed description of substitutions and preferred embodiments
aacactctccaccgtcagggaataagacttattattttattaacaattcaatttttatttattaattacgnctggacgaggagtactggtttatttgatgagagacatggcagtccaagtcaaactcgtttgtctgaccat

SEQ ID NO: 129 - DNA, 139 bp, Zea mays
  modified_base (71)..(71): a, c, t, g, or absent
  See specification as filed for detailed description of substitutions and preferred embodiments
gggaataagacttattattttattaacaattcaatttttatttattaattacgtctggacgaggagtactngtttatttgatgagagacatggcagtccaagtcaaactcgtttgtctgaccatggcggtgatggccgg

SEQ ID NO: 130 - DNA, 134 bp, Zea mays
  modified_base (68)..(68): a, c, t, g, or absent
  See specification as filed for detailed description of substitutions and preferred embodiments
tttatttgatgagagacatggcagtccaagtcaaactcgtttgtctgaccatggcggtgatggccggntgcaggttggggagcgcggcctgcagctctccggtgggcagaagcagcgcatcgccatcgcccgcg

SEQ ID NO: 131 - DNA, 141 bp, Zea mays
  modified_base (65)..(74): a, c, t, g, or absent
  See specification as filed for detailed description of substitutions and preferred embodiments
gtcgtacatgtgttcagtcatttccgtccattactactacgaccgtgctcacccgtgccgacgcnnnnnnnnnngccgtgcatggtccccgtcccggctggaacgcgtcctcggaagagagagatagagcacagcagacag

SEQ ID NO: 132 - DNA, 8667 bp, Zea mays
aataagttgagtcggggtagatctcaaggctacataaaatagttttttttctagaatggatgcatttgttttaagagaaaaatgatgcacttggaatgcatcaagcgaagggatgcaagaatgttggaaaaacacatgaacccgtatcgcgagatgcttatttagccattcttttatcacagtggatgcatatgcaacaaaaccaaaacagatggttagcgagtgacagtatatagagatctaaagattccgacacttcatcggtaaaaaaagcagcattaaccgagtgaatggaagaaaaacgaatttctcatattacacaacaggttttcttaaaaaaaaaaacgttacctcggtatttatattaagaagagactaaaatatggtcccgtcgagaaaatttctaaacactagtcttcatcactagtgagccgtcaccatctagtttgcaacggtccagtcagagtgcaggacataactcaggactcaagagcagacggagcacggtgagagaattttttttaatcaagcctaaaattcacctccggacaaattgaacctggaacgggtgctactcataaatattaaccatgagaccttttcgccgcagcaggttttctatcggcagttagattttagtgacgatgaaaatgatagaacgcaacgtgccgcatgcatccattcccattcgttttccacagtacatgtaggagtactgtgcaagtagggtccgtacattcagtctctctcaccagttggactcttctactgctacaaagacatgagctgcctggaatgggaaccggaggagcgagcgagcctgacggtctcacacacacacagtcacactcccaagccaattattataagaggcgagatgagcaactccagctcttaaccaatccactcctcctccctctccacctcctctgctttgctctgccactctgctgaggtggggggcagaggagctccccctccctcctctcccctcctcgccatgtctagcagcgacccggaggagatcagggcgcgcgtcgtcgttctcggttcgccccatgccgacggcggcgacgagtgggcccggcccgagctcgaggccttccatctgccgtctcccgcccaccagcctcctggcttcctagccgggcaaccggaagcagcagagcaacccacgctccctgctcctgctggccgcagcagcagcagcagcaacacgcctactacatctgccggtggcggcgctgctcctcctcctccttcttcgcctccccctccgccggcttctctggagaccgagcagccgcccaatgccaggccagcctccgccggcgccaatgacagcaagaagcccaccccgcccgccgccctgcgcgacctcttccgcttcgccgacggcctcgactgcgcgctcatgctcatcggcaccctcggcgcgctcgtccacggctgctcgctccccgtcttcctccgcttcttcgccgacctcgtcgactccttcggctcccacgccgacgacccggacaccatggtccgcctcgtcgtcaagtacgccttctacttcctcgtcgtcggagcggcaatctgggcatcctcgtgggcaggtacgctatccctcctcctcctgccgccccagcttgtgtgcgtcgcgaattggcggtcaatttggattggatgacaaatcacgtcggtcagccaatcgccgtggctacaaacgagatgttcaaatcgttcgccccgctcgcagagatctcttgctggatgtggaccggcgagcggcagtcgacgcggatgcggatccggtacctggacgcggcgctgcggcaggacgtgtccttcttcgacaccgacgtgcgggcctcggacgtgatctacgccatcaacgcggacgcagtggtggtgcaggacgccatcagcgagaagctgggcaacctcatccactacatggccaccttcgtggccggcttcgtcgtggggttcacggccgcgtggcagctggcgctggtcacgctggccgtggtgccgctcatcgccgtcatcggcgggctgagcgccgccgcgctcgccaagctctcgtcccgcagccaggacgcgctctccggcgccagcggcatcgcggagcaggcgctcgcgcagatacggatcgtgcaggcgttcgtcggcgaggagcgcgagatgcgggcctactcggcggcgctggccgtggcgcagaggatcggctaccgcagcggcttcgccaagggtctcggcctcggcggcacctacttcaccgtcttctgctgctacgggctcctgctctggtacggcggccacctcgtgcgcgcccagcacaccaacggcgggctcgccatcgccaccatgttctccgtcatgatcggcggactgtaaggcccaccacaccactctctccttctcctgctcctcggcccgcccgtcgtcattgctgctgacggtgtctgtggatcgcgtgcagggccctcgggcagtcggcgccgagcatggccgcgttcgccaaggcgcgtgtggcggctgccaagatcttccgcatcatcgaccacaggccgggcatctcctcgcgcgacggcgcggagccagagtcggtgacggggcgggtggagatgcggggcgtggacttcgcgtacccgtcgcggccggacgtccccatcctgcgcggcttctcgctgagcgtgcccgccgggaagaccatcgcgctggtgggcagctccggctccgggaagagcacggtggtttcgctcatcgagaggttctacgaccccagcgcaggtatactacctagtactgttactacttttagcgcattaatctgaggatgtccagttcgcttgcttgccaatcgccattgccatcgcaacaatacattgccaactgccattgctgggtagactagtactgtagtacagtagcagttagaagaagcctccactgtacattgcattgccaaacaaaagtgaattgtgcagtaactctgtaccaccacattgacatggaaatgaagtgaatgcttggagcatgcagagctggccggcctcatgggctgctgctacctgctagctagccaaccagaaccagccatcctctttcttgcttttctttttactttctttggtcgtggctgtttgtggtcatacatacattcacgcgcagagcagaagagctagctaagctaggtgggtgtgcctgcaacgcgggacaaagaaaactatttgttgcctggcaagatgctactgttgcctagcacatgcctgccattgaccgactgctcagtgagaagtggttcagttgtgctgttgacagtatagatagatatatatatagtagccctgtatattttctttttcagacaagaaaaaaagaagaacgagatgaagtctgcaattcggttttggcagggcaaatcctgctggacgggcacgacctcaggtcgctgaagctgcgatggctgcggcggcagatcgggctggtgagccaggagccggcgctgttcgcgacgagcatcagggagaacctgctgctggggcgggacagccagagcgcgacgctggcggagatggaggaggcggccagggtggccaacgcccactccttcatcatcaaactccccgacggctacgacacgcaggtccgtcccgtatagctagctcactagctgcactgccacttctctcgcttgctccccaccgttgctgcctgttgctctccaatccacttgtcggtgtctggaccacacgtgcctgcttgcctagctgctccacatctgctttccctgtccaaccttatgcaactcactcagtcactctatactatatcaaatacatttctagagtttaaagcttatcttagaataaatgcatctttagctacgagacaacctaacttcagttgttgttgttttttttactttctctcttctcaaaaatacattgattacgtctttacagcgatctttttattccaaacctaaaaatgcatgcactcactctaaaagcgcaaagggagcatcttttttccccatcatctgcacgcagccttttcttttcctcatgtcacgagggactgaaggtgtgtatgcagcgtcaagtcatccatccgttccactccactcactcatgcgtcgcgcactctgcgctcgtgcctgcccggggctaaagctttagtagctagcctcagatcagatactgttcgtgtttgttaggccgcggcagcggcacatgagctcatgacagccggcagcaccaccaccaacaccatggaagaggggtcggggtccatcacatagacatagatgcctgttgtagactagggacgggagggcaattgttaggcgcctgttgccatcgcatttgctgctgtgggttgccaacaagtaacatgccaggatgctttgctatcacgcacaggacaggaggagaggtcctttttctcgacacaagatctactaaactagcacttgctgatgagtgcataggatgaatggatgatgaacatctagagtgagagagagaaaatatgttaataataataaagagtagtaatagtagtagtaggattaagaatcaacctggggtacgtaggaagaggtacaatccctaggaatctagagtatgagaagtatgggaggagttgtgagtgaaacggaacaaattccgagttggtattttgtcgggaatgtcaagttgatttttgatcctagtgcaagcaagaattatcaatcactcagactcagcctgtctgtgtctgtccaccccagctcttgctactctacttactactgtgctactagtggtagggtaggtatcttccataaactgttattataaactgtcatctgagaaagagagccagtcaaacccatgctgctgcttatttttaatcactgtcaaatggcaggcaggcaggcagtctggttagttaataacatctgggaagggtttaatcaaaccaaatcaaatcatacgaaatctagaggccacatgggatggggccatatgtactgtactagcataagtagcggctagattttattagaacacggactcacactcccataactataactgactttgatcatgattccttgccaagcaatgctcgcatgcccatgcatgcatcatccctggtcaaactcaaacactctccaccgtcagggaataagacttattattttattaacaattccatttttatttattaattacggctggacgaggagtactagtttatttgatgagagacatggcagtccaagtcaaactcgtttgtctgaccatggcggtgatggccggttgcaggttggggagcgcggcctgcagctctccggtgggcagaagcagcgcatcgccatcgcccgcgccatgctcaagaaccccgccatcctgctgctggacgaggccaccagcgcgctggactccgagtctgagaagctcgtgcaggaggcgctggaccgcttcatgatcgggcgcaccaccctggtgatcgcgcacaggctgtccaccatccgcaaggccgacgtggtggccgtgctgcagggcggcgccgtctccgagatgggcgcgcacgacgagctgatggccaagggcgagaacggcacctacgccaagctcatccgcatgcaggagcaggcgcacgaggcggcgctcgtcaacgcccgccgcagcagcgccaggccctccagcgcccgcaactccgtcagctcgcccatcatgacgcgcaactcctcctacggccgctccccctactcccgccgcctctccgacttctccacctccgacttcaccctctccatccacgacccgcaccaccaccaccggaccatggcggacaagcagctggcgttccgcgccggcgccagctccttcctgcgcctcgccaggatgaactcgcccgagtgggcctacgcgctcgccggctccatcggctccatggtctgcggctccttcagcgccatcttcgcctacatcctcagcgccgtgctcagcgtctactacgcgccggacccgcggtacatgaagcgcgagatcgcaaaatactgctacctgctcatcggcatgtcctccgcggcgctgctgttcaacacggtgcagcacgtgttctgggacacggtgggcgagaacctgaccaagcgggtgcgcgagaagatgttcgccgccgtgctccgcaacgagatcgcctggttcgacgcggacgagaacgccagcgcgcgcgtggccgccaggctagcgctggacgcccagaacgtgcgctccgccatcggggaccgcatctccgtcatcgtccagaactcggcgctgatgctggtggcctgcaccgcggggttcgtcctccagtggcgcctcgcgctcgtgctcctcgccgtgttcccgctcgtcgtgggcgccaccgtgctgcagaagatgttcatgaagggcttctcgggggacctggaggccgcgcacgccagggcgacgcagatcgcgggcgaggccgtggccaacctgcgcaccgtggccgcgttcaacgcggagcgcaagatcacggggctgttcgaggccaacctgcgcggcccgctccggcgctgcttctggaaggggcagatcgccggcagcggctacggcgtggcgcagttcctgctgtacgcgtcctacgcgctggggctgtggtacgcggcgtggctggtgaagcacggcgtgtccgacttctcgcgcaccatccgcgtgttcatggtgctgatggtgtccgcgaacggcgccgccgagacgctgacgctggcgccggacttcatcaagggcgggcgcgcgatgcggtcggtgttcgagacgatcgaccgcaagacggaggtggagcccgacgacgtggacgcggcgccggtgccggagcggccgaggggcgaggtggagctgaagcacgtggacttctcgtacccgtcgcggccggacatccaggtgttccgcgacctgagcctccgtgcgcgggccgggaagacgctggcgctggtggggccgagcgggtgcggcaagagctcggtgctggcgctggtgcagcggttctacgagcccacgtccgggcgcgtgctcctggacggcaaggacgtgcgcaagtacaacctgcgggcgctgcggcgcgtggtggcggtggtgccgcaggagccgttcctgttcgcggcgagcatccacgagaacatcgcgtacgggcgcgagggcgcgacggaggcggaggtggtggaggcggcggcgcaggcgaacgcgcaccggttcatcgcggcgctgccggaggggtaccggacgcaggtgggcgagcgcggggtgcagctgtcgggagggcagcggcagcggatcgcgatcgcgcgcgcgctggtgaagcaggcggccatcgtgctgctggacgaggcgaccagcgcgctggacgccgagtcggagcggtgcgtgcaggaggcgctggagcgcgcggggtccgggcgcaccaccatcgtggtggcgcaccggctggccacggtgcgcggcgcgcacaccatcgcggtcatcgacgacggcaaggtggcggagcaggggtcgcactcgcacctgctcaagcaccatcccgacgggtgctacgcgcggatgctgcagctgcagcggctgacgggcgcggcggccgggcccgggccgtcgacctcgtgcaacggggccgcgtaggacggaatggatggatggatgggtttggttcctcgagagattgatgggtgaggaagctgaagctccggatcaaatggtggtactccatgatcgcaacaatgaggggaaaaaaagaaaggagaaaatacggtggttcatatgattgtacaatttgacgatctgtttgagtcggggttttaggatgatgtaaaccttcactcgccttttttttactcttgtttctcatccgcatcagtatcatctatctacatacagtgtcagagatgggaactgatccgcatcatcatctacctcccaaggcaccccagattgtattaatgtacttagttagcctgttttatatatacttataagtaccaaatagcagaattttactccttatctgcagtagcacgaaagaagaaacggcaagctacacctatctctggaagcaaaagaatctccccattctctctcttcctacgaggacaccccatccttttcagacagacagacagacggaccaaactgcaccacccaagaaccgatcgagagcagaggtagcattctctgcactgtagagtgtagaccatactacgctgctctcgagacatgatcccgggaatatctaccgaattgtttgtcagtggcatagccgcatagctctcagctgcctaatgaattgtttggtgccaaccgcgctgcaggcttgcagacgacccgggaagggtcagggattgcacaactactagcatcagtggagagcgaaaggccagaacggcaggcttgcaggaaaacagggaccgtgagtttgacctggccttggggtggggagtcagtcagtcacatgcgatgcgatgcagtggaggaacccatcttccaacgcacgcggcacgattgatttcagggttgctttcgccgctgccaatccaccgatccctggacactggtgcgttccttcgtcgcacatgacggtgcgtcgccccaaccgcacaggactgggagaagggacggattgggg

SEQ ID NO: 133 - DNA, 23 bp, Zea mays
gctcatcgagaggttctacgacc

SEQ ID NO: 134 - DNA, 23 bp, Zea mays
atgatgaaggagtgggcgttggc

SEQ ID NO: 135 - DNA, 23 bp, Zea mays
cgatctcgcgcttcatgtaccgc

SEQ ID NO: 136 - DNA, 23 bp, Zea mays
gtgggcagaagcagcgcatcgcc

SEQ ID NO: 137 - DNA, 23 bp, Zea mays
cctacatcctcagcgccgtgctc

SEQ ID NO: 138 - DNA, 18 bp, Artificial Sequence
  Description of Artificial Sequence: Synthetic primer MD1502
ccatcctgcgcggcttct

SEQ ID NO: 139 - DNA, 19 bp, Artificial Sequence
  Description of Artificial Sequence: Synthetic primer MD1508
atctcgttgcggagcacgg

SEQ ID NO: 140 - DNA, 19 bp, Artificial Sequence
  Description of Artificial Sequence: Synthetic primer MD1518-2
gttcgcgacgagcatcagg

SEQ ID NO: 141 - DNA, 40 bp, Artificial Sequence
  Description of Artificial Sequence: Synthetic oligonucleotide
ggtttcgctcatcgagaggtccaccctggccgcctcctcc

SEQ ID NO: 142 - DNA, 40 bp, Artificial Sequence
  Description of Artificial Sequence: Synthetic oligonucleotide
ggtagtatacctgcgctggcactccttcatcatcaaactc

SEQ ID NO: 143 - DNA, 40 bp, Artificial Sequence
  Description of Artificial Sequence: Synthetic oligonucleotide
tggtttcgctcatcgagagggtccggcgcgtagtagacgc

SEQ ID NO: 144 - DNA, 40 bp, Artificial Sequence
  Description of Artificial Sequence: Synthetic oligonucleotide
tgacattcccgacaaaatactgctacctgctcatcggcat

SEQ ID NO: 145 - DNA, 40 bp, Artificial Sequence
  Description of Artificial Sequence: Synthetic oligonucleotide
ggtttcgctcatcgagaggtgtccggcgcgtagtagacgc

SEQ ID NO: 146 - DNA, 40 bp, Artificial Sequence
  Description of Artificial Sequence: Synthetic oligonucleotide
gagtttgatgatgaaggagtccagcgcaggtatactacct

SEQ ID NO: 147 - DNA, 40 bp, Artificial Sequence
  Description of Artificial Sequence: Synthetic oligonucleotide
tttcgctcatcgagaggttcgccaccctggccgcctcctc

SEQ ID NO: 148 - DNA, 40 bp, Artificial Sequence
  Description of Artificial Sequence: Synthetic oligonucleotide
tctactacgcgccggacccgatgaagcgcgagatcgcaaa

SEQ ID NO: 149 - DNA, 40 bp, Artificial Sequence
  Description of Artificial Sequence: Synthetic oligonucleotide
ggtttcgctcatcgagaggttcaccctggccgcctcctcc

SEQ ID NO: 150 - DNA, 40 bp, Artificial Sequence; identical to SEQ ID NO: 142
  Description of Artificial Sequence: Synthetic oligonucleotide

SEQ ID NO: 151 - DNA, 40 bp, Artificial Sequence; identical to SEQ ID NO: 148
  Description of Artificial Sequence: Synthetic oligonucleotide

SEQ ID NO: 152 - DNA, 40 bp, Artificial Sequence
  Description of Artificial Sequence: Synthetic oligonucleotide
tttcgctcatcgagaggttccagcgcaggtatactaccta

SEQ ID NO: 153 - DNA, 40 bp, Artificial Sequence
  Description of Artificial Sequence: Synthetic oligonucleotide
gaggaggcggccagggtggcactccttcatcatcaaactc

SEQ ID NO: 154 - DNA, 40 bp, Artificial Sequence
  Description of Artificial Sequence: Synthetic oligonucleotide
tctactacgcgccggacccgaagcgcgagatcgcaaaata

SEQ ID NO: 155 - DNA, 40 bp, Artificial Sequence
  Description of Artificial Sequence: Synthetic oligonucleotide
gtttcgctcatcgagaggttgtatactacctagtactgtt

SEQ ID NO: 156 - DNA, 40 bp, Artificial Sequence
  Description of Artificial Sequence: Synthetic oligonucleotide
gagatggaggaggcggccagcactccttcatcatcaaact

SEQ ID NO: 157 - DNA, 40 bp, Artificial Sequence
  Description of Artificial Sequence: Synthetic oligonucleotide
gtctactacgcgccggaccctgaagcgcgagatcgcaaaa

SEQ ID NO: 158 - DNA, 40 bp, Artificial Sequence
  Description of Artificial Sequence: Synthetic oligonucleotide
tttcgctcatcgagaggttcgaccccagcgcaggtatact

SEQ ID NO: 159 - DNA, 40 bp, Artificial Sequence
  Description of Artificial Sequence: Synthetic oligonucleotide
gaggaggcggccagggtggaactccttcatcatcaaactc

SEQ ID NO: 160 - DNA, 40 bp, Artificial Sequence
  Description of Artificial Sequence: Synthetic oligonucleotide
ggtttcgctcatcgagaggtcgggtccggcgcgtagtaga

SEQ ID NO: 161 - DNA, 40 bp, Artificial Sequence
  Description of Artificial Sequence: Synthetic oligonucleotide
ggagtttgatgatgaaggaggaagcgcgagatcgcaaaat

SEQ ID NO: 162 - DNA, 40 bp, Artificial Sequence
  Description of Artificial Sequence: Synthetic oligonucleotide
ttcgctcatcgagaggttctccttcatcatcaaactcccc

SEQ ID NO: 163 - DNA, 40 bp, Artificial Sequence
  Description of Artificial Sequence: Synthetic oligonucleotide
tacgcgccggacccgcggtaagcgcgagatcgcaaaatac

SEQ ID NO: 164 - DNA, 40 bp, Artificial Sequence
  Description of Artificial Sequence: Synthetic oligonucleotide
gtttcgctcatcgagaggttccctggccgcctcctccatc

SEQ ID NO: 165 - DNA, 40 bp, Artificial Sequence
  Description of Artificial Sequence: Synthetic oligonucleotide
ctaggtagtatacctgcgctctccttcatcatcaaactcc

SEQ ID NO: 166 - DNA, 40 bp, Artificial Sequence
  Description of Artificial Sequence: Synthetic oligonucleotide
ggtttcgctcatcgagaggtatactacctagtactgttac

SEQ ID NO: 167 - DNA, 40 bp, Artificial Sequence; identical to SEQ ID NO: 153
  Description of Artificial Sequence: Synthetic oligonucleotide

SEQ ID NO: 168 - DNA, 40 bp, Artificial Sequence
  Description of Artificial Sequence: Synthetic oligonucleotide
ctactacgcgccggacccgcatgaagcgcgagatcgcaaa

SEQ ID NO: 169 - DNA, 877 bp, Zea mays
gtcgtgcccctctctagagataaagagcattgcatgtctaaagtataaaaaattaccacatatttttttgtcacacttatttgaagtgtagtttatctatctctatacatatatttaaacttcactctacaaataatatagtctataatactaaaataatattagtgttttagaggatcatataaataaactgctagacatggtctaaaggataattgaatattttgacaatctacagttttatctttttagtgtgcatgtgatctctctgttttttttgcaaatagcttgacctatataatacttcatccattttattagtacatccatttaggatttagggttgatggtttctatagactaatttttagtacatccattttattctttttagtctctaaattttttaaaactaaaactctattttagttttttatttaataatttagatataaaatgaaataaaataaattgactacaaataaaacaaataccctttaagaaataaaaaaactaagcaaacatttttcttgtttcgagtagataatgacaggctgttcaacgccgtcgacgagtctaacggacaccaaccagcgaaccagcagcgtcgcgtcgggccaagcgaagcagacggcacggcatctctgtagctgcctctggacccctctcgagagttccgctccaccgttggacttgctccgctgtcggcatccagaaattgcgtggcggagcggcagacgtgaggcggcacggcaggcggcctcttcctcctctcacggcaccggcagctacgggggattcctttcccaccgctccttcgctttcccttcctcgcccgccgtaataaatagacaccccctccacaccctctttcccc

SEQ ID NO: 170 - DNA, 3750 bp, Artificial Sequence
  Description of Artificial Sequence: Synthetic polynucleotide
atggcgggatctaagaagagaagaattaaacaagattcgaagctcgagaagttcaccaactgctactcgctgagcaagacgctgcggttcaaggcgatccccgtcgggaagacccaggagaacatcgacaacaagcggctcctggtcgaggacgagaagcgcgccgaggactacaagggcgtcaagaagctgctggaccggtactacctctccttcatcaacgacgtcctgcactcgatcaagctcaagaacctgaacaactacatctcgctgttccgcaagaagacacggaccgagaaggagaacaaggagctcgagaacctcgagatcaacctgcgcaaggagatcgcgaaggcgttcaagggcaacgaggggtacaagagcctgttcaagaaagacatcatcgagaccatcctgccggagttcctggacgacaaggacgagatcgcgctggtgaactcgttcaacgggttcaccacggccttcaccgggtttttcgacaaccgggagaacatgttcagcgaggaggccaagtcgaccagcatcgccttccggtgcatcaacgagaacctcacccgctacatcagcaacatggacatcttcgagaaggtggacgccatcttcgacaagcacgaggtccaggagatcaaggaaaagatcctgaactcggactacgacgtggaagacttctttgagggcgagttcttcaacttcgtcctcacccaggagggcatcgacgtctacaacgccatcatcggcggcttcgtgacggagagcggcgagaagatcaagggcctcaacgagtacatcaacctctacaaccagaagactaagcagaagctcccgaagttcaagccgctgtacaagcaagtcctgagcgaccgggagtccctctcgttctacggcgagggctacacgagcgacgaggaggtgctggaggtgttccgcaacacgctgaacaagaacagcgagatcttcagctcgatcaagaaactcgagaagctgttcaagaacttcgacgagtacagcagcgccggcatcttcgtcaagaacgggcccgcgatcagcaccatcagcaaggacatcttcggggagtggaacgtgatccgcgacaagtggaacgccgagtacgacgacatccacctcaagaaaaaggcggtggtcacggagaagtacgaggacgaccgccggaagtccttcaagaaaatcgggagcttcagcctcgagcagctccaggagtacgcggacgccgacctgagcgtggtggagaagctcaaggagatcatcatccagaaggtcgacgagatctacaaggtctacggctcgagcgagaagctgttcgacgcggacttcgtgctggagaagtccctcaagaagaacgacgccgtggtggccatcatgaaggatctgctcgacagcgtgaagtcgttcgagaactacatcaaggcattctttggggagggcaaggagacgaaccgggacgagtccttctacggggacttcgtgctcgcgtacgacatcctcctgaaggtcgaccacatctacgacgcgatccggaactacgtcacgcagaagccctacagcaaggacaagttcaagctctacttccagaacccgcagttcatgggcgggtgggacaaggacaaggagaccgactaccgggccacgatcctgcggtacgggtccaagtactacctcgccatcatggacaagaagtacgccaagtgcctccagaagattgacaaggacgacgtgaacgggaactacgagaagatcaactacaagctcctcccggggcccaacaagatgctgccgaaggtgttcttcagcaagaagtggatggcctactacaacccctcggaggacatccagaagatatacaagaacggcacgttcaaaaagggggacatgttcaacctgaacgactgccacaagctgatcgactttttcaaggacagcatcagccgctacccgaagtggtcgaacgcctacgacttcaacttctcggagacggagaagtacaaggacattgcgggcttctaccgggaggtggaggagcagggctacaaggtctccttcgagagcgcctccaagaaagaggtggacaagctcgtggaggagggcaagctgtacatgttccagatctacaacaaggacttctcggacaagtcgcacggcaccccgaacctccacacgatgtacttcaagctgctgttcgacgagaacaaccacgggcagatccgcctcagcggcggggcggagctgttcatgcgccgcgcgtccctcaagaaggaggagctggtcgtgcaccccgccaactccccgatcgcgaacaagaaccccgacaaccccaagaagacaaccaccctctcgtacgacgtctacaaggacaagcggttctcggaggaccagtacgagctgcacatcccgatcgccatcaacaagtgccccaagaacatcttcaagatcaacaccgaggtgcgggtgctgctcaagcacgacgacaacccctacgtcatcgggatcgaccgcggcgagcggaacctgctctacatcgtggtcgtggacgggaaggggaacatcgtggagcagtacagcctgaacgagatcatcaacaacttcaacggcatccgcatcaagacggactaccacagcctcctggacaagaaggagaaggagcggttcgaggcgcggcagaactggacctccatcgagaacatcaaggagctgaaggccggctacatcagccaggtcgtgcacaagatctgcgagctcgtggagaagtacgacgcggtgatcgcgctggaggacttgaacagcgggttcaagaactcccgggtcaaggtcgagaagcaggtctaccagaagttcgagaagatgctgatcgacaagctcaactacatggtggacaagaagtccaacccctgcgccaccggcggcgccctcaagggctaccagatcaccaacaagttcgagtccttcaagtcgatgtctacgcagaacgggttcattttctacatcccggcgtggctcaccagcaagatcgacccgagcacgggcttcgtcaacctcctgaagaccaagtacaccagcatcgcggacagcaagaagttcatctcctcgttcgaccgcatcatgtacgtccccgaggaagacctgttcgagttcgccctcgactacaagaacttctcccggacggacgccgactacatcaaaaagtggaagctctacagctacggcaaccggatccgcatcttccgcaaccccaagaagaacaatgtgttcgactgggaggaggtgtgcctgacgagcgcctacaaggagctcttcaacaagtacggcatcaactaccagcaaggggacatccgcgcgctgctctgcgagcagtccgacaaggcgttctactcgtcgttcatggccctgatgagcctcatgctccagatgcgcaacagcatcaccggccggacggacgtggacttcctgatcagcccggtcaagaacagcgacggcattttctacgacagccggaactacgaggcccaggagaacgccatcctccccaagaacgccgacgcgaacggcgcctacaacatcgcgcggaaggtgctgtgggccatcggccagtttaaaaaggcggaggacgagaagctggacaaggtcaagatcgccatcagcaacaaggagtggctcgagtacgcgcagacgagcgtgaagcacggatctaagaagagaagaattaaacaagattga

SEQ ID NO: 171 - DNA, 30 bp, Artificial Sequence
  Description of Artificial Sequence: Synthetic oligonucleotide
ggatctaagaagagaagaattaaacaagat

SEQ ID NO: 172 - DNA, 200 bp, Artificial Sequence
  Description of Artificial Sequence: Synthetic polynucleotide
cggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaatt

SEQ ID NO: 173 - DNA, 19 bp, Artificial Sequence
  Description of Artificial Sequence: Synthetic primer
cagatacggatcgtgcagg

SEQ ID NO: 174 - DNA, 20 bp, Artificial Sequence
  Description of Artificial Sequence: Synthetic primer
gcacctacttcaccgtcttc

SEQ ID NO: 175 - DNA, 19 bp, Artificial Sequence
  Description of Artificial Sequence: Synthetic primer
tggacttctcgtacccgtc

SEQ ID NO: 176 - DNA, 18 bp, Artificial Sequence
  Description of Artificial Sequence: Synthetic primer
ctggtgcagcggttctac

SEQ ID NO: 177 - DNA, 20 bp, Artificial Sequence
  Description of Artificial Sequence: Synthetic probe
tggcgcagaggatcggctac

SEQ ID NO: 178 - DNA, 19 bp, Artificial Sequence
  Description of Artificial Sequence: Synthetic probe
ttccgcgacctgagcctcc

SEQ ID NO: 179 - DNA, 31 bp, Artificial Sequence
  Description of Artificial Sequence: Synthetic primer
tcgcgcagatacggatcgtgcaggcgttcgt

SEQ ID NO: 180 - DNA, 4548 bp, Zea mays
ggtggggggcagaggagctccccctccctcctctcccctcctcgccatgtctagcagcgacccggaggagatcagggcgcgcgtcgtcgttctcggttcgccccatgccgacggcggcgacgagtgggcccggcccgagctcgaggccttccatctgccgtctcccgcccaccagcctcctggcttcctagccgggcaaccggaagcagcagagcaacccacgctccctgctcctgctggccgcagcagcagcagcagcaacacgcctactacatctgccggtggcggcgctgctcctcctcctccttcttcgcctccccctccgccggcttctctggagaccgagcagccgcccaatgccaggccagcctccgccggcgccaatgacagcaagaagcccaccccgcccgccgccctgcgcgacctcttccgcttcgccgacggcctcgactgcgcgctcatgctcatcggcaccctcggcgcgctcgtccacggctgctcgctccccgtcttcctccgcttcttcgccgacctcgtcgactccttcggctcccacgccgacgacccggacaccatggtccgcctcgtcgtcaagtacgccttctacttcctcgtcgtcggagcggcaatctgggcatcctcgtgggcagagatctcttgctggatgtggaccggcgagcggcagtcgacgcggatgcggatccggtacctggacgcggcgctgcggcaggacgtgtccttcttcgacaccgacgtgcgggcctcggacgtgatctacgccatcaacgcggacgcagtggtggtgcaggacgccatcagcgagaagctgggcaacctcatccactacatggccaccttcgtggccggcttcgtcgtggggttcacggccgcgtggcagctggcgctggtcacgctggccgtggtgccgctcatcgccgtcatcggcgggctgagcgccgccgcgctcgccaagctctcgtcccgcagccaggacgcgctctccggcgccagcggcatcgcggagcaggcgctcgcgcagatacggatcgtgcaggcgttcgtcggcgaggagcgcgagatgcgggcctactcggcggcgctggccgtggcgcagaggatcggctaccgcagcggcttcgccaagggtctcggcctcggcggcacctacttcaccgtcttctgctgctacgggctcctgctctggtacggcggccacctcgtgcgcgcccagcacaccaacggcgggctcgccatcgccaccatgttctccgtcatgatcggcggactggccctcgggcagtcggcgccgagcatggccgcgttcgccaaggcgcgtgtggcggctgccaagatcttccgcatcatcgaccacaggccgggcatctcctcgcgcgacggcgcggagccagagtcggtgacggggcgggtggagatgcggggcgtggacttcgcgtacccgtcgcggccggacgtccccatcctgcgcggcttctcgctgagcgtgcccgccgggaagaccatcgcgctggtgggcagctccggctccgggaagagcacggtggtttcgctcatcgagaggttctacgaccccagcgcagggcaaatcctgctggacgggcacgacctcaggtcgctgaagctgcgatggctgcggcggcagatcgggctggtgagccaggagccggcgctgttcgcgacgagcatcagggagaacctgctgctggggcgggacagccagagcgcgacgctggcggagatggaggaggcggccagggtggccaacgcccactccttcatcatcaaactccccgacggctacgacacgcaggttggggagcgcggcctgcagctctccggtgggcagaagcagcgcatcgccatcgcccgcgccatgctcaagaaccccgccatcctgctgctggacgaggccaccagcgcgctggactccgagtctgagaagctcgtgcaggaggcgctggaccgcttcatgatcgggcgcaccaccctggtgatcgcgcacaggctgtccaccatccgcaaggccgacgtggtggccgtgctgcagggcggcgccgtctccgagatgggcgcgcacgacgagctgatggccaagggcgagaacggcacctacgccaagctcatccgcatgcaggagcaggcgcacgaggcggcgctcgtcaacgcccgccgcagcagcgccaggccctccagcgcccgcaactccgtcagctcgcccatcatgacgcgcaactcctcctacggccgctccccctactcccgccgcctctccgacttctccacctccgacttcaccctctccatccacgacccgcaccaccaccaccggaccatggcggacaagcagctggcgttccgcgccggcgccagctccttcctgcgcctcgccaggatgaactcgcccgagtgggcctacgcgctcgccggctccatcggctccatggtctgcggctccttcagcgccatcttcgcctacatcctcagcgccgtgctcagcgtctactacgcgccggacccgcggtacatgaagcgcgagatcgcaaaatactgctacctgctcatcggcatgtcctccgcggcgctgctgttcaacacggtgcagcacgtgttctgggacacggtgggcgagaacctgaccaagcgggtgcgcgagaagatgttcgccgccgtgctccgcaacgagatcgcctggttcgacgcggacgagaacgccagcgcgcgcgtggccgccaggctagcgctggacgcccagaacgtgcgctccgccatcggggaccgcatctccgtcatcgtccagaactcggcgctgatgctggtggcctgcaccgcggggttcgtcctccagtggcgcctcgcgctcgtgctcctcgccgtgttcccgctcgtcgtgggcgccaccgtgctgcagaagatgttcatgaagggcttctcgggggacctggaggccgcgcacgccagggcgacgcagatcgcgggcgaggccgtggccaacctgcgcaccgtggccgcgttcaacgcggagcgcaagatcacggggctgttcgaggccaacctgcgcggcccgctccggcgctgcttctggaaggggcagatcgccggcagcggctacggcgtggcgcagttcctgctgtacgcgtcctacgcgctggggctgtggtacgcggcgtggctggtgaagcacggcgtgtccgacttctcgcgcaccatccgcgtgttcatggtgctgatggtgtccgcgaacggcgccgccgagacgctgacgctggcgccggacttcatcaagggcgggcgcgcgatgcggtcggtgttcgagacgatcgaccgcaagacggaggtggagcccgacgacgtggacgcggcgccggtgccggagcggccgaggggcgaggtggagctgaagcacgtggacttctcgtacccgtcgcggccggacatccaggtgttccgcgacctgagcctccgtgcgcgggccgggaagacgctggcgctggtggggccgagcgggtgcggcaagagctcggtgctggcgctggtgcagcggttctacgagcccacgtccgggcgcgtgctcctggacggcaaggacgtgcgcaagtacaacctgcgggcgctgcggcgcgtggtggcggtggtgccgcaggagccgttcctgttcgcggcgagcatccacgagaacatcgcgtacgggcgcgagggcgcgacggaggcggaggtggtggaggcggcggcgcaggcgaacgcgcaccggttcatcgcggcgctgccggaggggtaccggacgcaggtgggcgagcgcggggtgcagctgtcgggagggcagcggcagcggatcgcgatcgcgcgcgcgctggtgaagcaggcggccatcgtgctgctggacgaggcgaccagcgcgctggacgccgagtcggagcggtgcgtgcaggaggcgctggagcgcgcggggtccgggcgcaccaccatcgtggtggcgcaccggctggccacggtgcgcggcgcgcacaccatcgcggtcatcgacgacggcaaggtggcggagcaggggtcgcactcgcacctgctcaagcaccatcccgacgggtgctacgcgcggatgctgcagctgcagcggctgacgggcgcggcggccgggcccgggccgtcgacctcgtgcaacggggccgcgtaggacggaatggatggatggatgggtttggttcctcgagagattgatgggtgaggaagctgaagctccggatcaaatggtggtactccatgatcgcaacaatgaggggaaaaaaagaaaggagaaaatacggtggttcatatgattgtacaatttgacgatctgtttgagtcggggttttaggatgatgtaaaccttcactcgccttttttttactcttgtttctcatccgcatcagtatcatctatctacatacagtgtcagagatgggaactgatccgcatcatcatctacctcccaaggcaccccagattgtattaatgtacttagttagcctgttttatatatacttataagtaccaaat

SEQ ID NO: 181 - protein, 1379 aa, Zea mays
MSSSDPEEIRARVVVLGSPHADGGDEWARPELEAFHLPSPAHQPPGFLAGQPEAAEQPTLPAPAGRSSSSSNTPTTSAGGGAAPPPPSSPPPPPASLETEQPPNARPASAGANDSKKPTPPAALRDLFRFADGLDCALMLIGTLGALVHGCSLPVFLRFFADLVDSFGSHADDPDTMVRLVVKYAFYFLVVGAAIWASSWAEISCWMWTGERQSTRMRIRYLDAALRQDVSFFDTDVRASDVIYAINADAVVVQDAISEKLGNLIHYMATFVAGFVVGFTAAWQLALVTLAVVPLIAVIGGLSAAALAKLSSRSQDALSGASGIAEQALAQIRIVQAFVGEEREMRAYSAALAVAQRIGYRSGFAKGLGLGGTYFTVFCCYGLLLWYGGHLVRAQHTNGGLAIATMFSVMIGGLALGQSAPSMAAFAKARVAAAKIFRIIDHRPGISSRDGAEPESVTGRVEMRGVDFAYPSRPDVPILRGFSLSVPAGKTIALVGSSGSGKSTVVSLIERFYDPSAGQILLDGHDLRSLKLRWLRRQIGLVSQEPALFATSIRENLLLGRDSQSATLAEMEEAARVANAHSFIIKLPDGYDTQVGERGLQLSGGQKQRIAIARAMLKNPAILLLDEATSALDSESEKLVQEALDRFMIGRTTLVIAHRLSTIRKADVVAVLQGGAVSEMGAHDELMAKGENGTYAKLIRMQEQAHEAALVNARRSSARPSSARNSVSSPIMTRNSSYGRSPYSRRLSDFSTSDFTLSIHDPHHHHRTMADKQLAFRAGASSFLRLARMNSPEWAYALAGSIGSMVCGSFSAIFAYILSAVLSVYYAPDPRYMKREIAKYCYLLIGMSSAALLFNTVQHVFWDTVGENLTKRVREKMFAAVLRNEIAWFDADENASARVAARLALDAQNVRSAIGDRISVIVQNSALMLVACTAGFVLQWRLALVLLAVFPLVVGATVLQKMFMKGFSGDLEAAHARATQIAGEAVANLRTVAAFNAERKITGLFEANLRGPLRRCFWKGQIAGSGYGVAQFLLYASYALGLWYAAWLVKHGVSDFSRTIRVFMVLMVSANGAAETLTLAPDFIKGGRAMRSVFETIDRKTEVEPDDVDAAPVPERPRGEVELKHVDFSYPSRPDIQVFRDLSLRARAGKTLALVGPSGCGKSSVLALVQRFYEPTSGRVLLDGKDVRKYNLRALRRVVAVVPQEPFLFAASIHENIAYGREGATEAEVVEAAAQANAHRFIAALPEGYRTQVGERGVQLSGGQRQRIAIARALVKQAAIVLLDEATSALDAESERCVQEALERAGSGRTTIVVAHRLATVRGAHTIAVIDDGKVAEQGSHSHLLKHHPDGCYARMLQLQRLTGAAAGPGPSTSCNGAA

SEQ ID NO: 182 - DNA, 8800 bp, Zea mays
taaatttgtgatccttgtgaagttgttatatcatgaattgtgaacttgttgcatttgtgatcttttgtcaactttgttgtattgtgaagtttgatatgtttaccgatcgtattttagatttcgatcgttaccggtgtattttccgcaccaaacttttgtttccgatgttttcgaaataccgatatcgtttccgtttctatagttacccttttcaattttatttccgattaaaaatatgaaaacggtaatggttttagtgtttatcgaccgttttcatctctaatcatccctgccggtgaagtttaatttttcccttggctaaagagatgcaagctgctgtaaaatacgttaaaacaggcaaggcagccccagcagccagcatcgcgtgcccgtctatgtacatcagtggatacgtagcatctctagtgagtaatataacgattgcatttggctggaggacgtatgttatataagtatgtcatttaccagttgcattagtatcttccctaactcctataataactctcttcgtggaatggacgtagacgtatgctatataagtattaaaaaatagttttttaagctggtgtcctcaattttgctattgttctcgtttttatctttagttgtgtcacaaatttaatccgtacaacaaatcaaaaataccatacccttcttatattaattttctaacataacatttgtttagatattttcagtcgtgaaaatacaattctaattctaacgtcgtagtatcaaatcaaaccatccagaatttgaccaagcttaattataaaaaatataaaatttatgatactgaatagatagcattagatttgttatataatatatttttataaaataccatttttatggtataaatattggtactcctttactttaaactatagatagttttgactaaggatgcaactagaattgcatcctcttttcactgcaccttcattagttttaatatttatttagatgggcccttgcaaactgtagatatcatctcttgcaacattctttctatagcaccacgaaaatgtattgcggctttgaaattataattgaattagttgtatcatttctttcaccgatgcgttaaattcaaaattaagtgttatatttcttcataatttgttaaatatatagaccctataatccaccattatttactataatagcatacattaacattggttttagcctacactacgacactcgaggcattgaattttcctctatcaaagaattatatgtgtagtagtattgttcttgacaaaaagggggattaaaattaaactaccaatattgatacttatcttatcacatccatgaatacaatcaacactcttacaaaagataagatacaagattaaaaagtaccatgataatacattaagattattagcaatgcattaaattaaataaatgtgcaagtgaatcatgattttagttttatctattttacttttaaaatatgatattctctgactacttctaagcataaatgtgattctaagtcatgaccgatcgtgcttattcagaaaaatgaaggagacacagatttctataaaaaaaggttgtcatgggactattgggtcaaccatcttattcatttgggaaaataagtttagaacacatcaacccattttagatgttgagtttggccctaatggtccattgaccttacttttgtgggttgacatagaccatctatcccaagttattgttgtgtcacattccctgatatcatgaatctatattttagctttccgttttcatatttttagtcgttacatattttttatccgcgtactagattaaaactctagttgttgcaatacattttgttcatttttttctatttcttctttactaacaacatattctagttcctagctacattcttaagtaccatagtgctataaacattttttatcctacattattccacttaagaaattgaattttctgcataaaaaaattatatgtccagtagtgttgtcttataaaagcataaagtgattaaaattaaaaccattattgatatcttatttttcaaaaaaaaatataagcttatagaaagtgaattaatttcatggtaaattaatatagtttaaattgaattattagtgttattactatgtttattatcaatgaaacatttttcatggttgatataacttagtgttacttattttagtattttttatataattctagttaacttttagtttttgatttaaaaaaacgagaattgtgtccttttgtggagtgagtataaagaaagtaatatctgttcatcataatttggttttttaaggtacgtgaaacttgctttatatttggactcaagctatgtctaaatacatagtaaaaaagcaatatttctagaaaagacaaaacatcttataatttagaatcaaggaaatatatagattttatgtgcagtgagaagccatttacaatggaacgttcaacgttgggccaatagatattttgcgatatgatgatgggcatatttttgcatggttgtccctccactagctatagtttgatgatacgatacgctgcacacaccattgggttgtaccatgttagtgtagcaacagtagaaacccaattgtggccgtgaaccatgataatactaggtagagtgctagctagaggtttcaggctattgatgcgtgaattaaactttctgttgtgttgcgaggaaacgagtattgtgaaatatttgaaacggttttttttgtgaaagatttgaaacggtatttttgttgtgaaataaagatcaaggctaaataaattcaaactaataaaacatattaattgacggcctgaagcccccgcccccatggccccatgccatagcatcaggtcccacatgacatgaggccgcgcctccctctatgttggctccctgccttcgccgttgtcgtcgctcccgaactccctctcctcccctgttacaaatacccccacccgcccggacagcttccctgcacactcgcagctcgcacatctcatggtgtcctaagaacggcaagagccagctctgcctagcagcagcgcacagccacatccatggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcaccggcaccctcggccaagatttcgagccagtggggtgagtaaagaagaagatggcgccgaatttacatttataagtaggaccagcagaagcccctgcccctgggggccttagcattgcattcgactgatgaatacgcatggcaggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggtaacgaacgaaagcgccggctcctctgcttttcttggcctctttgtccctgccctgtgctgctgtgcatattcattcattcagttctctgtggggttttttttttgtttaatttttttttgggatcgtatccagtgcacaagggccacgccgtgcacaaatgcacaaaacgaaatctggccgtccattttccatccaacgacatgacggcgcggggggtttttcacaaaacagactcggcaagctacggaggttgcgggagggttcatctgcatatttacgacggccgttggatggaaaatggacggccagatttcgttttgtgtatttgtgcacggcgtggcccttgtgcactggatacgatcccatttttttttttgccccgaatcctagtggacctaactggacagattacagcacgcacacgtaggcatgtcatgtagcagcactgcagtcgggtgcagtccagtccagtcctgtccagccgcgacactgtagtacatagcgatgcaacggagacacgcgttggagttggttccatctcttctcggcggccgtgccgaggcttccgcggggaagctgcgacaacagaacggaccgccgggggtgggcaggcagcaagctccctgttggcttgtgccgttgcgcagcggcgggtaccggacaacgctttcggcggcgcgcggcctcgtcggcttcccctgtttttgatgccgcctctcggtgtccggggaccgggaggatcgatggggcccgtgccgtctgatccgccacgcgagcggtcctatgcgatgcgccgcacgagcgcgggggggccgtggaacagtacacagctgggtcactcactcactcatcccgctggttgtggctgcttggttgcaacttggctcggctgtctgtctgttgcccccgccgcgttttctagccgtttccgctttgctcgcggtttcgctggcgatccggcacgcggcgcccacacccggggctggccccttggccgagtgggtggcaggcacttgcatgcatccggccggtttcccgcgaccaagctggcccgccgcaacaatgagagtgagacgagactttgtgtcagtgtgtgtatgtacatgtatgtctgcgcgacagccctaccgtccgacacgatgattcttgtgcactgtactgtactgtactaactccccccaccccctccggtatgtaacgcatgccatatgcaggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctaacgagccggccgtctctttcgccggggcccgcgcggggttcgcccacgtggtgatcaggtggcagacatgtggcccacgggccccgcgccgccttccccatttttggacgaccctactgctactactactagtgtacatatgcaaaaaaatacatatatatataggtactttctctaatatttttatatataagcaaggcggcctggtgttcttttctttgttttgtcgacaactgtttgatcccatcctatggacgatggatagttcaatgtttgtacgtacgtaactactctctatagactagaatgggctcatgaaactggaccgatcgacacggacgtcacgtgcgtctggtaccggtagtgcaacgggtgccgaatgtttgctgggcccggacgagaatcgcttctcctcgtcctcggtcctcaccctgaacgaacgaataaggaaaatgctgcaccgaaagctccagacgtttccgaattccaaattccaaaaccccaaatcttcttgcttcacatcagtcttacccggttcatctgtgacaaaaaaaaaatagtgctagtttaggaactcaggtcgagattgaaggcaattgtggaggaatttaccctataatccttatgagaatttgagttcccaaactaactgagttggagcattcaacatttccctaaattttgtgcacatgtttctttgctatttatctttggacatgggacgatgggagacgcagatttaggggacccttcaattcagaacttcaggtgcacaaaccgaggttggcttgcctgcattcttgtttcggacatgcccaactaggccactactcactaccttcatctgagataccaattgctgacctaaatgacaagtatacacttacatttcagtgatagctgcaacaaaaaaaaaaatcttaccgcattttatctctgcattctgcatgccgcatcctgaacattacgtatctttcccggtgctctgttgcgttctcacgcagttgatggcatgcagtcttgcgccaccgaatccagtgtactggtcgtggtgacttgtcgcacagacagcagcccggcagcaccaagcgtgtcactgtaaactgttgggcgttaaacaacaacttgcacaacagctcaaatatggcatatgctatccgacaaactgaacaaggtgcccaattgatctgaatgtacctgtgatttccagcactatcgtacagcaacgttgtcaaaacaagtggggtggggttggggacagattttttcgataaagaagcttttataaaaaataacaatgatacaaatcctgggttatagatgtacagaaagcacgaagcacgaaagtccagtccaaagcacgtttttttgcctggtactagcccgatccggccggcacgaataagcgggtcgagctcggacgggaagctaagcacgacggactagcccgacacgacccgtttacctctaatcccgttaaacccgcttttttgcactaaaccgtgcttaccgaaccgtttagcccgttttttggcctgatttttcgtgcttaacgggccaggctcggacaaggaaacaagcccgcgggcttagacgatccggcctggttttttaaccgtgcctagcgggtcgagcccaaaataggtcgggcttcactgggcccgagccgggcgacccgtttggccatctctaacctgagtacaacttccgacttctgcaaaatacatacagccaaataaaagaaaagtaaaaagatctaaaaaatctcagctagaaacaatcaatccgaagactagatcgcctcccataagtctggaaaaaagagaccatggccacttgcaccaagatgtgtgcattattctacggttacaccaaagatttttgttctttaagggctagtttgggaaccataattttcaaagggatttctattttcctaaggaaaattagttcatttttccataagaaattagaaatccattggaaaattgtggttctcaaactagccctaagcgtcgaaaagaaccatatgcatatctagagacaaaattcctctaatttctattcaggcttcagcacatatacttcacgtgcttgcgtcaagttccttgggccgccacatggacttatggacttctcgacgcagcgaaagccgtcgttgcccttggtgtagctaggtcatccgcacctcccactggccagtggccactgcagggacttggccatgggcttgtttggttcagcttttttctgaccagcttttctgaaaatctggctgtgtgaagaatctggctgtgagagaatctgagtatcattacgattacgtgtggatgaagataaagttgttcatagggctcaggatctagaaagtgacggattcctactattacaatgactcaaccgattatgtgtttatgttgattttggatgatttttgccccaacaaattttatagaagctggctgaaaagctgagcgtttggcagtccacaacagtttttggtggccagaagctgccagaagccgatacaaacagggtccatgctttccatttcgtttaccgtgtacgcggtgtccctcacaatcaatcagtttaccttgtggctccaacacacatcaacctcggcacaacaacactgtgaatcattttcggcggtccatattattttcgacggttcatccctggccgccgaaaattgtctgttattttcggcggcttgacctagccgtcgaaaataggctgctattttcggcggccaaatccgagccgccgaaaataaggcttttaaaaaccgtcggctccttcttcttctctgttctttctctcctctcccaaagcccgccgccgctcacccgccgctcgctcgccgggctgcccgccactccgccgtcgtcgtcgagccaccgcatcgagaggtaaattttttttgcgtgttttattccttattttcggcggttgatatttaggcgccgccaaaattagtgtatatttgtaattgtgtttgtttaattactatttgtaattagtattattgtttaattcgatttcattaatgtattagtggtatatgtgatttagggattaggggcatattgtatttaggcattaatttcatattaatatgtggtattattatattattggttttaatagtacattatattggtacgtagaatagttgcattattagtgtttgtggtacttagtttgacttgat

SEQ ID NO: 183 - DNA, 1522 bp, Zea mays; identical to SEQ ID NO: 7

SEQ ID NO: 184 - DNA, 1161 bp, Zea mays; identical to SEQ ID NO: 8

SEQ ID NO: 185 - protein, 386 aa, Zea mays; identical to SEQ ID NO: 9

SEQ ID NO: 186 - DNA, 8859 bp, Zea mays
cctattttgtgtctaatactcttcttatattaattgtttggtcaaactttagataaatttgactaatgatgcaattaaaactgcatcacctttactaaggtactgctttatatgtttcgacaaaattttcaattattctctatgtgttttaatctttgcgctacacctccattgatttaaatactcatttattttaaaccataacttaaattatatcggatctttgcatcctttctatggcaccatacatgaatcgatattttggctgcaaatttttaatcatgttagttttagcattttttcatatccatgtgttaagtttgaatcatgtgttgtttttatataatttattgaaaatatagatcctaaacttcactaatacttacaacaatagcatcatcatgtgttttaatccacgccacaacactcaaggcattgaattttcttctaccaaagagttgtatgtgtgtattgttctttaaaaaatagagtgattataattaaactaccagtattcatatgtaaaatgtatagacatctaaaataaaatttgcaaaaaacattgttgcagactttcaatataattaagaatgggttttagggtcatgatatatggtttgttaaagaaacttgtttttttttgcaattgataaactataaaatacattttcactattgtgtgcatatgtacttggtatacatagtggcatatatcatttttgtttactttgaggtttgaattatctatgttaaaattggataacatagatacattggtgtgcgtcctttggcccatttacttgactgaggagcaatactataaagtaaaacatatttggatattttatcttaaactcctagcataatattgatttaattatgaacaaatatatgtttaggtgatagtttcatgggtggtaaactatataagaaggcttaccatgatctttgcaaactctaggctatgaaagagttccatgatttgtcttagaagcatagacaaaacagtgataatgatctaaatcacacttatggcactgatgaccatatatgcaaagctaaatgcatgttaagttgtattatatcatatgtttacaatgactatcgcatataacgaggaatacattgtctatatagatagctattactgtagtagtgccaaatgttggacaacatgaatcataatcttcaaacctagagaaattgtagtcagtcgtacacatatcgtctagtaagttgtctatactttttatttattgtatcaaattttattgttatcttgcttgcttgtttgtttgtaccatagacacaatatggtcaaaaagtggtcaatcgattcgaagaagattgcaattgacgagtgctaacagttgatccttttgttgtgcacgctagcggagtagcatgaaaagagtaaaatatgaaattagcgttctaaactgtttgtgctataggtacttcgtatttaatggagtgactaactataggaaggtgagagctcagaagtcagcaccctcacacagagttctagagttagtggtcatcgaaccacgacaaactacatgatgagcagaagaggcaacatcaagactatgatcaatagtttcgggtcaatgaatgacatcgtgatgagtatttatctaactatatagaacaacaacacatgatgttttaagtaagttcaactgatcttctattgctatctttaagtatttaacgtagcgaataatgttttatctatttcattcataaataatgttgtgacaaaaggggataaccatcacttttaccatgttctagataccacaaccatctccaccatcataatgggttcttcattggtgcttggacctcaaataatcatatctatagccaacttagctcaattctaataaaattaggcaacttggcttcattgtagcaaaaatagccaacttagctcaattttatctaaacttagctaatctagcacaacttagatcaatattaggaaaaactaatcaatctaatctagctcaactatagcgaaagatagatattgtagcataacttagtagatctatctcaaattttagcaaaaactaatcaatttagataaactctataaaattttaatcattatgacttatttccaactaattgtaacttgcatgatttttatgttccttctttataattagcaacacctaaagacacgaatgatgaggggtctaacgcattcattaaccagttgttaaataatactctaggtagatgataagaactctaattattctatgaatctaagctaaaagatgtttaatatttaagtattggtgtttattatgttatttagaacgattcatgttacttaaagatttgttatgatttttaaatatgattatgataatttatgtggtgtggattaacttgtgaacatatgtgatgtagatgaatatgtatgttgtggatggaaccatatgaatatatatacacactcatatactattcgttggtgtaggtaaagcttcatccatcggtaattactaaatggtcttcagtcattaccactaggtgaagcttcacacgaccgataattattgaagaacgctcattaatttccggtaatggcttattggccttcactagtcggtgaaaattagctatttttataccaataaaaattagctaatatatgtaaaccaggtctaatttttatgggcctcttaccgaccaaaattgattagattattgttacaatagttttagtcaaaagctagctatgctataaaaattttgaattaaagtgagtttcgtaataaaaattgcatacttttaaaataaaataattaaaaaacagtttttagaaatacaatcaaacaccttatgctataaaaaaattgtaatgtacctacaaatatataatactttactttaaaataggcctgtgccttctcggctctatatgggctgcctccaacgaagcgccatggccatgggctccactgtgtcgggtcccacatgaggccgcgcctccctccaaatgttccctccctgccttcgtctttgtcgttgctcgcaaactccctgtcctcccctgttacaaatacccccacccgcccggacagcttccctgcatacttgcagctcgcacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcggctaccacgacggcgccgcgtcgcctgtcgtcgtggactacttcgtcggcaccctcggccaggatttcgagccaatggggtaagtaaggtagtaagaaggagcgccggtttacatttaccgcacgtcggcgtgcggtcgagtcgggactcgggagacgtatgaacccccgtcccgtcccatgcatgtgtggcaggtgggtgtaccagaggtactgcgaggagatgaaggagctgtcgctgacgatcatggagctgctggagctgagcctgggcgtggagctgcgcggctactaccgggagttcttcgaggacagccggtccatcatgcggtgcaactactacccgccgtgcccggagccggagcgcacgctgggcacgggcccgcactgcgaccccacggcgctcaccatcctcctgcaggacgacgtgggcgggctggaggtgctggtggacggtgagtggcgccccgtccggcccgtcccgggcgccatggtcatcaacatcggcgacaccttcatggtaacgaaacgaaagcgctcgctcctctgttttccttggccgctcttgtcctgtgtgtatattcagttgagctctctctgtgctgttatttcccgaatcctagtggacctaaacgggcaggttattacagcacgcacacgtaggcatgtcatgtagctagtacatacatagcgatgccgatgcaaatgcaatagagacatgcgttcgagttggttcctatctcggcgggctacggcaggtacacgcggccgcggcgcgctctctctagtctatccgcggccgcgcccaggccgatcgaggcttccgggggagagttgcgacaagagaacggaccgagggggtcggctagcggtagcaagttccctgttggtttgtggcgttggagcgttgcggagaggcttgcgcggcggcggggacgtcgacggggacgtggcggggagacgatacgatgggtgccgggcagggcaacgctttcggcgggtggccgtgtccaggtgcgcgcggccttgtcggtttccccctctcggtgtccatggccgagaaatgggtcgacgaccgagaccgacgctcggtgcggcgcccatcccgtctgatccgccgcgccacgcgagcggccctatgcgatgccgcacgggcgcggagggccgtcgcgcggagtataatgtatagtatatagtacaaggttggttggagtcgggttgggttggatcgggtcaccggtacgtggtggctgctgttgcccccgccgtttccgcttgcacttttgtcgcggtttcgctggcgatccggcacgcggcgcccacaccacgccggggctccaaacagctcgggcccttggccgtgtgggtggcaggcacttgcacgcgtccggttgtcgcggcctggcccgccgccgggcgcaccgcaacaatgagacagcccgacacgatgattcttgtgcactgtgctaacccgcatgccatgcaggcgctgtcgaacgggaggtacaagagctgcctgcaccgcgcggtggtgaaccagcggcgggcgcggcggtcgctggccttcttcctgtgcccgcgcgaggaccgggtggtgcgcccgccggccagtgctgcgccgcggcgctacccggacttcacctgggccgacctcatgcgcttcacgcagcgccactaccgcgccgacacccgcacgctggacgccttcacccgctggctctcccacggcccggcccaggcggcggcgcctccctgcacctagcgagccgggccaaggccgtctctttcgccccacgtgcgcgcccagctgggcaggtggccagacacgcggcccgcgggccccgcgccgccttgccattttttgacgctggccctactgctgtgctactagtgtacatatgcaagagtacatatatatatatatatatacgtattttctatatattatatataaaagcaaggcggcccggtgcccttctcttgttttgtccacaactgtttgatcccattattctatggaccatggatacttcaatgtttgtactaagaccgtgaacgtgggattcttttccttcctctgtgttttttctgagaaaaattaaactgatttctgtgaaatttctttgttttaacaagaaaacagaaaaattacatgaggaaaacgctccatttatttcaacaagaaaaaaatacatgaaacagaaggagaaaaaacgtgttcgttctatcattttcacacgagaaaaaaaaacatagaaaacagaaaaactccccgcgttcagatgagctcaagaaaatggaacgacacggacgtcacccgcgtcttgtagcagtgggcgcacgggtgccgaatgtttgctgggcccccaagagaatcgcttctcctcacgctgaatgaatgaatcaacgagggaaacgctgcaccctgagttccagacgtttccgaattccaaacgtttttgtggcgtgcgtccatggggcgcccccaaacttcggacgtttccggcgctccaacaaatcttctcgcttcacacgtcaccgtcgtcccggattcatttgcctcgtcgctccaccattcgctgctctcctctccacgtactcttaccctgacctttgggaaagaactgaacattcgagatgcacaacagttcaaatataacatatgcagcacaagatcgttcgactgctatccgacaagccaacaacgtgcccagtagaactgaatgtacctgtgatttccagcactaacttacagcaacgttgtgaaaaaacaaaaacgaaaacaaacggcagaaaaaacagatgtattgttctacagttacaccaaatattttctggtcctttcagcaccaacaagagccatacgcatatctagaagacaaaattcctctaatttcacccctacgtggtagcagttcctcctcaacacagttcacgtgctagcgtcgagttctttgggccgccacatcgacttctcgacgcagagcaggccctcgctgcccttggtgtaggtcatccgcacctcccactgcacggacttggccatgctctccagctcatttatcgtgtccgcggtgtccctcacgatcagcttgccctgtggcctcagtacacggtcgacctcggcgaaaactgcagccagtttgcatctgtaaacaggcaacacagatttttagtatctaaaacactgcaggcaaacgccacaggttttagtcgcaagaagcaataaaagcatgcaaacaatgctacgtgtacgtatcaaaggaacatgtcaaaactcgttgcatgaacgatcattgatgtttccttgctgaactagtcacatcagtctgcttcaacttctgggtttcactagtagatataccagaagggtagaataatgtgaagagcaagaaatacagacctctttctgagctttgagaacagatggtccgcgtgcagaaggtcatacgttcttgggtaagtgctgaaagactcgcaccagtcatggtacatgccaaacaaaccgcgctcgtagatgatgggcagcgtgtctggtgaatcgatcggcacgatattcatgacccagaccttttggtccctcagagctgcagcaaaactgccatgcaacaatgtaaagcattagtcaagaagaaggtgtacagtgcatttctccttgtcaacagtcttcagtaacaaaaaaaaagtgttatgcttgactgaatctttcaaagaaatatgcttgatgacttatggtggacaagttgcctgttatagtgttatgttttaattaactatgtgccagcttgggtaactagtagttatgtagtgtgatctgaattaccaaaatataaataaataaataaacatgcccaagaaactacgaaaaccatttacttaccctccatagacagctctcatgtccatgacatttctcactttggaccagtcaattcccatgccattcacatacgatttacttacaacccgtttccagtgggcattatctgcctcaaaatcttcatttgcaggctttccatagacaccaaccttggaaccatcaatccagaaaggggtcttctcaagcctttgcggccataactctggccattttgatcctcggacttttgagccaccaggcagtttgtgcatgcatgcttccaacggtacattcctgcaaatcaaaaggctgtgtaagcaaagcagagaagcacttttctccattgaaaatatactcttctcaaagaaccgaaaccataccaagcagcatctgcatcatcagattccttgcacaatggcgggctgttttcagatcttttctcatagcaaatattgtccattggtttctgatatatgaccataccaacttggtttaacttatccttagtcttgttgaccatcttccagcacatggactttgtcaaagtagacatggctgaaaagggtatgtggccacatgttatgttagaaataaaattcaattttgaacagttggtccatagcatgtattttgaacaaatgcaatccttctccatccatgaaagaagttgacccttcatacttaggattattcagtactttcactcatgtctgctgaatttgttctcttggtagttgctatacaagaaagggggaagtacagagtagctaaacttatacaagctatagtctgatatttgtatgaaacataaattttggtatggatgtcttattaaaatgggaggttgtataatatttttctagcctacctcaacttgcttgagactaaaaggctttgttgttgttgttgaggctgtatggtgctttgactttacaaatcaagttatcagctaccctacttatggatatacacctctcataaaatgatggtaagaagtttcgatatgtcacattaacataagaacttcattcagttagggtacaacgaagttaagtagttacggaaataccattccaaatctcaacatcctctgggagcttttggtaaacaggagtggcagaccagacaaagtaaccaccagggcgtaacaagcggttcaattccagcaaaagcatgccacctaaaagtagcgagccagcaataagattcagttctatagcaaatcaataaatgaaaggaggacatgtcaatatgtaaccagcaggacaaaccttcgatgtgccaaggga

SEQ ID NO: 187 - DNA, 1733 bp, Zea mays; identical to SEQ ID NO: 13

SEQ ID NO: 188 - DNA, 1392 bp, Zea mays; identical to SEQ ID NO: 14

SEQ ID NO: 189 - protein, 463 aa, Zea mays; identical to SEQ ID NO: 15

SEQ ID NO: 190 - protein, 1229 aa, Unknown
  Description of Unknown: Lachnospiraceae bacterium ND2006 sequence
ASKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMRGWDKDKETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHA

SEQ ID NO: 191 - DNA, 33 bp, Solanum tuberosum
atgggtagcaaaaagaggcgtatcaagcaggac

SEQ ID NO: 192 - DNA, 30 bp, Solanum tuberosum
ggatctaagaagcgtaggatcaagcaagat

SEQ ID NO: 193 - DNA, 200 bp, Zea mays; identical to SEQ ID NO: 172

SEQ ID NO: 194 - DNA, 665 bp, Zea mays
gtcgttgctcgcaaactccctgtcctcccctgttacaaatacccccacccgcccggacagcttccctgcatacttgcagctcgcacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcg

SEQ ID NO: 195 - DNA, 582 bp, Zea mays
cacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcg

SEQ ID NO: 196 - DNA, 23 bp, Zea mays
ctggaaggagaccctgtccttcg

SEQ ID NO: 197 - DNA, 23 bp, Zea mays
ccggcaccctcggccaagatttc

SEQ ID NO: 198 - DNA, 23 bp, Zea mays
ctccctgccttcgtctttgtcgt

SEQ ID NO: 199 - DNA, 23 bp, Zea mays
ctgcatacttgcagctcgcacat

SEQ ID NO: 200 - DNA, 23 bp, Zea mays
ctggaaggagaccctgtcgttcg

SEQ ID NO: 201 - DNA, 23 bp, Glycine max
gtaagaagctcttcaccgttcca

SEQ ID NO: 202 - DNA, 18 bp, Artificial Sequence
  Description of Artificial Sequence: Synthetic PCR primer MD2611
cacgcccacgtccaccat

SEQ ID NO: 203 - DNA, 27 bp, Artificial Sequence
  Description of Artificial Sequence: Synthetic PCR primer MD2615
agaactgaatgaatgaatatgcacagc

SEQ ID NO: 204 - DNA, 19 bp, Artificial Sequence
  Description of Artificial Sequence: Synthetic PCR primer LR1151
acgggttcttccaggtgtg

SEQ ID NO: 205 - DNA, 21 bp, Artificial Sequence
  Description of Artificial Sequence: Synthetic PCR primer LR1148
ttcatctcctcgcagtacctc

SEQ ID NO: 206 - DNA, 877 bp, Zea mays; identical to SEQ ID NO: 169

SEQ ID NO: 207 - DNA, 400 bp, Zea mays
tcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagc

SEQ ID NO: 208 - DNA, 3042 bp, Artificial Sequence
  Description of Artificial Sequence: Synthetic genome edited sequence
atggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagacccaaggtctccttccaggggagcttggccgcgaaccggtcggcgtgcgcgctcgtgtacccggacacggtgccggggacgcgccgggcgcgctgcttctcggcgagcggcagccggaagaagtcgctggcgccgtccagcgcggcgcgccccagcgccgcgtccacgccgtgcccgcacacctggaagaacccgtgcgtcgcgcacgccgcggccacctgcgccgcggcgcgccgcagccccgcgcggtcgccattgcgcagcacgcccacgtccaccatcggcacctccagctccgcggccgaggacggccgcgcctcttcctgcggccacaggaatggcgcggggatcttgggctcccggcgcaggtcgaacacggccgcgccggccttgctggccgccgcgtcggccttgtccttgccagcggggaggtcaatgctggggctgggagtgggggcgcggaggaggagcggcggggccgggctggcgtccatggacgtggctgcgcgcttggcgctgctgctgctgctgctaggcacagctggctcttgtcgttcctgcgacaccatgaggcttccacgacggcgccgcggcgcccgtcgtcgtggactacttcaccggcaccctcggccacgagccagtggggtgagtaaagaagaagatggcgccgaatttacatttataagtaggaccagcagaagcccctgcccctgggggccttagcattgcattcgactgatgaatacgcatggcaggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggtaacgaacgaaagcgccggctcctctgcttttcttggcctctttgtccctgccctgtgctgctgtgcatattcattcattcagttctctgtggggttttttttttgtttaatttttttttgggatcgtatccagtgcacaagggccacgccgtgcacaaatgcacaaaacgaaatctggccgtccattttccatccaacgacatgacggcgcggggggtttttcacaaaacagactcggcaagctacggaggttgcgggagggttcatctgcatatttacgacggccgttggatggaaaatggacggccagatttcgttttgtgtatttgtgcacggcgtggcccttgtgcactggatacgatcccatttttttttttgccccgaatcctagtggacctaactggacagattacagcacgcacacgtaggcatgtcatgtagcagcactgcagtcgggtgcagtccagtccagtcctgtccagccgcgacactgtagtacatagcgatgcaacggagacacgcgttggagttggttccatctcttctcggcggccgtgccgaggcttccgcggggaagctgcgacaacagaacggaccgccgggggtgggcaggcagcaagctccctgttggcttgtgccgttgcgcagcggcgggtaccggacaacgctttcggcggcgcgcggcctcgtcggcttcccctgtttttgatgccgcctctcggtgtccggggaccgggaggatcgatggggcccgtgccgtctgatccgccacgcgagcggtcctatgcgatgcgccgcacgagcgcgggggggccgtggaacagtacacagctgggtcactcactcactcatcccgctggttgtggctgcttggttgcaacttggctcggctgtctgtctgttgcccccgccgcgttttctagccgtttccgctttgctcgcggtttcgctggcgatccggcacgcggcgcccacacccggggctggccccttggccgagtgggtggcaggcacttgcatgcatccggccggtttcccgcgaccaagctggcccgccgcaacaatgagagtgagacgagactttgtgtcagtgtgtgtatgtacatgtatgtctgcgcgacagccctaccgtccgacacgatgattcttgtgcactgtactgtactgtactaactccccccaccccctccggtatgtaacgcatgccatatgcaggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctaa

SEQ ID NO: 209 - DNA, 569 bp, Artificial Sequence
  Description of Artificial Sequence: Synthetic genome edited sequence
aaggtctccttccaggggagcttggccgcgaaccggtcggcgtgcgcgctcgtgtacccggacacggtgccggggacgcgccgggcgcgctgcttctcggcgagcggcagccggaagaagtcgctggcgccgtccagcgcggcgcgccccagcgccgcgtccacgccgtgcccgcacacctggaagaacccgtgcgtcgcgcacgccgcggccacctgcgccgcggcgcgccgcagccccgcgcggtcgccattgcgcagcacgcccacgtccaccatcggcacctccagctccgcggccgaggacggccgcgcctcttcctgcggccacaggaatggcgcggggatcttgggctcccggcgcaggtcgaacacggccgcgccggccttgctggccgccgcgtcggccttgtccttgccagcggggaggtcaatgctggggctgggagtgggggcgcggaggaggagcggcggggccgggctggcgtccatggacgtggctgcgcgcttggcgctgctgctgctgctgctaggcacagctggctcttgtcgttcctgcgacaccatgag

SEQ ID NO: 210 - DNA, 2850 bp, Artificial Sequence
  Description of Artificial Sequence: Synthetic genome edited sequence
atggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagacgacacggtgccggggacgcgccgggcgcgctgcttctcggcgagcggcagccggaagaagtcgctggcgccgtccagcgcggcgcgccccagcgccgcgtccacgccgtgcccgcacacctggaagaacccgtgcgtcgcgcacgccgcggccacctgcgccgcggcgcgccgcagccccgcgcggtcgccattgcgcagcacgcccacgtccaccatcggcacctccagctccgcggccgaggacggccgcgcctcttcctgcggccacaggaatggcgcggggatcttgggctcccggcgcaggtcgaacacggccgcgccggccttgctggccgccgcgtcggccttgtccttgccagcggggaggtcaatgctggggctgggatttccacgacggcgccgcggcgcccgtcgtcgtggactacttcaccggcaccctcggccagccagtggggtgagtaaagaagaagatggcgccgaatttacatttataagtaggaccagcagaagcccctgcccctgggggccttagcattgcattcgactgatgaatacgcatggcaggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggtaacgaacgaaagcgccggctcctctgcttttcttggcctctttgtccctgccctgtgctgctgtgcatattcattcattcagttctctgtggggttttttttttgtttaatttttttttgggatcgtatccagtgcacaagggccacgccgtgcacaaatgcacaaaacgaaatctggccgtccattttccatccaacgacatgacggcgcgggggtttttcacaaaacagactcggcaagctacggaggttgcgggagggttcatctgcatatttacgacggccgttggatggaaaatggacggccagatttcgttttgtgtatttgtgcacggcgtggcccttgtgcactggatacgatcccatttttttttttgccccgaatcctagtggacctaactggacagattacagcacgcacacgtaggcatgtcatgtagcagcactgcagtcgggtgcagtccagtccagtcctgtccagccgcgacactgtagtacatagcgatgcaacggagacacgcgttggagttggttccatctcttctcggcggccgtgccgaggcttccgcggggaagctgcgacaacagaacggaccgccgggggtgggcaggcagcaagctccctgttggcttgtgccgttgcgcagcggcgggtaccggacaacgctttcggcggcgcgcggcctcgtcggcttcccctgtttttgatgccgcctctcggtgtccggggaccgggaggatcgatggggcccgtgccgtctgatccgccacgcgagcggtcctatgcgatgcgccgcacgagcgcgggggggccgtggaacagtacacagctgggtcactcactcactcatcccgctggttgtggctgcttggttgcaacttggctcggctgtctgtctgttgccccgccgcgttttctagccgtttccgctttgctcgcggtttcgctggcgatccggcacgcggcgcccacacccggggctggccccttggccgagtgggtggcaggcacttgcatgcatccggccggtttcccgcgaccaagctggcccgccgcaacaatgagagtgagacgagactttgtgtcagtgtgtgtatgtacatgtatgtctgcgcgacagccctaccgtccgacacgatgattcttgtgcactgtactgtactgtactaactcccccccccctccggtatgtaacgcatgccatatgcaggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctaa

SEQ ID NO: 211 - DNA, 387 bp, Artificial Sequence
  Description of Artificial Sequence: Synthetic genome edited sequence
tcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtc

SEQ ID NO: 212 - DNA, 3010 bp, Artificial Sequence
  Description of Artificial Sequence: Synthetic genome edited sequence
atggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctggcttccacgacggcgccgcggcgcccgtcgtcgtggactacttcaccggcacgcgaaccggtcggcgtgcgcgctcgtgtacccggacacggtgccggggacgcgccgggcgcgctgcttctcggcgagcggcagccggaagaagtcgctggcgccgtccagcgcggcgcgccccagcgccgcgtccacgccgtgcccgcacacctggaagaacccgtgcgtcgcgcacgccgcggccacctgcgccgcggcgcgccgcagccccgcgcggtcgccattgcgcagcacgcccacgtccaccatcggcacctccagctccgcggccgaggacggccgcgcctcttcctgcggccacaggaatggcgcggggatcttgggctcccggcgcaggtcgaacacggccgcgccggccttgctggccgccgcgtcggccttgtccttgccagcggggaggtcaatgctggggctgggagtgggggcgcggaggaggagcggcggggccgggctggcgtccatggacgtggctgcgcgcttggcgctgctgctgctgctgctaggcacagctggctcttgtcgttcctgcgacaccatgagttcgagccagtggggtgagtaaagaagaagatggcgccgaatttacatttataagtaggaccagcagaagcccctgcccctgggggccttagcattgcattcgactgatgaatacgcatggcaggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggtaacgaacgaaagcgccggctcctctgcttttcttggcctctttgtccctgccctgtgctgctgtgcatattcattcattcagttctctgtggggttttttttttgtttaatttttttttgggatcgtatccagtgcacaagggccacgccgtgcacaaatgcacaaaacgaaatctggccgtccattttccatccaacgacatgacggcgcggggggtttttcacaaaacagactcggcaagctacggaggttgcgggagggttcatctgcatatttacgacggccgttggatggaaaatggacggccagatttcgttttgtgtatttgtgcacggcgtggcccttgtgcactggatacgatcccatttttttttttgccccgaatcctagtggacctaactggacagattacagcacgcacacgtaggcatgtcatgtagcagcactgcagtcgggtgcagtccagtccagtcctgtccagccgcgacactgtagtacatagcgatgcaacggagacacgcgttggagttggttccatctcttctcggcggccgtgccgaggcttccgcggggaagctgcgacaacagaacggaccgccgggggtgggcaggcagcaagctccctgttggcttgtgccgttgcgcagcggcgggtaccggacaacgctttcggcggcgcgcggcctcgtcggcttcccctgtttttgatgccgcctctcggtgtccggggaccgggaggatcgatggggcccgtgccgtctgatccgccacgcgagcggtcctatgcgatgcgccgcacgagcgcgggggggccgtggaacagtacacagctgggtcactcactcactcatcccgctggttgtggctgcttggttgcaacttggctcggctgtctgtctgttgcccccgccgcgttttctagccgtttccgctttgctcgcggtttcgctggcgatccggcacgcggcgcccacacccggggctggccccttggccgagtgggtggcaggcacttgcatgcatccggccggtttcccgcgaccaagctggcccgccgcaacaatgagagtgagacgagactttgtgtcagtgtgtgtatgtacatgtatgtctgcgcgacagccctaccgtccgacacgatgattcttgtgcactgtactgtactgtactaactccccccaccccctccggtatgtaacgcatgccatatgcaggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctaa

SEQ ID NO: 213 - DNA, 542 bp, Artificial Sequence
  Description of Artificial Sequence: Synthetic genome edited sequence
ctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgc

SEQ ID NO: 214 - DNA, 3037 bp, Artificial Sequence
  Description of Artificial Sequence: Synthetic genome edited sequence
atggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctcggcttccacgacggcgccgcggcgcccgtcgtcgtggactacttcaccggcaccctcggccgagggtctccttccaggggagcttggccgcgaaccggtcggcgtgcgcgctcgtgtacccggacacggtgccggggacgcgccgggcgcgctgcttctcggcgagcggcagccggaagaagtcgctggcgccgtccagcgcggcgcgccccagcgccgcgtccacgccgtgcccgcacacctggaagaacccgtgcgtcgcgcacgccgcggccacctgcgccgcggcgcgccgcagccccgcgcggtcgccattgcgcagcacgcccacgtccaccatcggcacctccagctccgcggccgaggacggccgcgcctcttcctgcggccacaggaatggcgcggggatcttgggctcccggcgcaggtcgaacacggccgcgccggccttgctggccgccgcgtcggccttgtccttgccagcggggaggtcaatgctggggctgggagtgggggcgcggaggaggagcggcggggccgggctggcgtccatggacgtggctgcgcgcttggcgctgctgctgctgctgctaggcacagctggctcttgtcgttcctgcgaccgagccagtggggtgagtaaagaagaagatggcgccgaatttacatttataagtaggaccagcagaagcccctgcccctgggggccttagcattgcattcgactgatgaatacgcatggcaggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggtaacgaacgaaagcgccggctcctctgcttttcttggcctctttgtccctgccctgtgctgctgtgcatattcattcattcagttctctgtggggttttttttttgtttaatttttttttgggatcgtatccagtgcacaagggccacgccgtgcacaaatgcacaaaacgaaatctggccgtccattttccatccaacgacatgacggcgcggggggtttttcacaaaacagactcggcaagctacggaggttgcgggagggttcatctgcatatttacgacggccgttggatggaaaatggacggccagatttcgttttgtgtatttgtgcacggcgtggcccttgtgcactggatacgatcccatttttttttttgccccgaatcctagtggacctaactggacagattacagcacgcacacgtaggcatgtcatgtagcagcactgcagtcgggtgcagtccagtccagtcctgtccagccgcgacactgtagtacatagcgatgcaacggagacacgcgttggagttggttccatctcttctcggcggccgtgccgaggcttccgcggggaagctgcgacaacagaacggaccgccgggggtgggcaggcagcaagctccctgttggcttgtgccgttgcgcagcggcgggtaccggacaacgctttcggcggcgcgcggcctcgtcggcttcccctgtttttgatgccgcctctcggtgtccggggaccgggaggatcgatggggcccgtgccgtctgatccgccacgcgagcggtcctatgcgatgcgccgcacgagcgcgggggggccgtggaacagtacacagctgggtcactcactcactcatcccgctggttgtggctgcttggttgcaacttggctcggctgtctgtctgttgcccccgccgcgttttctagccgtttccgctttgctcgcggtttcgctggcgatccggcacgcggcgcccacacccggggctggccccttggccgagtgggtggcaggcacttgcatgcatccggccggtttcccgcgaccaagctggcccgccgcaacaatgagagtgagacgagactttgtgtcagtgtgtgtatgtacatgtatgtctgcgcgacagccctaccgtccgacacgatgattcttgtgcactgtactgtactgtactaactccccccaccccctccggtatgtaacgcatgccatatgcaggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctaa

SEQ ID NO: 215 - DNA, 562 bp, Artificial Sequence
  Description of Artificial Sequence: Synthetic genome edited sequence
gtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctc

SEQ ID NO: 216 - DNA, 3044 bp, Artificial Sequence
  Description of Artificial Sequence: Synthetic genome edited sequence
atggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagacccgtctccttccaggggagcttggccgcgaaccggtcggcgtgcgcgctcgtgtacccggacacggtgccggggacgcgccgggcgcgctgcttctcggcgagcggcagccggaagaagtcgctggcgccgtccagcgcggcgcgccccagcgccgcgtccacgccgtgcccgcacacctggaagaacccgtgcgtcgcgcacgccgcggccacctgcgccgcggcgcgccgcagccccgcgcggtcgccattgcgcagcacgcccacgtccaccatcggcacctccagctccgcggccgaggacggccgcgcctcttcctgcggccacaggaatggcgcggggatcttgggctcccggcgcaggtcgaacacggccgcgccggccttgctggccgccgcgtcggccttgtccttgccagcggggaggtcaatgctggggctgggagtgggggcgcggaggaggagcggcggggccgggctggcgtccatggacgtggctgcgcgcttggcgctgctgctgctgctgctaggcacagctggctcttgtcgttcctgcgacaccttcggcttccacgacggcgccgcggcgcccgtcgtcgtggactacttcaccggcaccctcggccaagatttcgagccagtggggtgagtaaagaagaagatggcgccgaatttacatttataagtaggaccagcagaagcccctgcccctgggggccttagcattgcattcgactgatgaatacgcatggcaggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggtaacgaacgaaagcgccggctcctctgcttttcttggcctctttgtccctgccctgtgctgctgtgcatattcattcattcagttctctgtggggttttttttttgtttaatttttttttgggatcgtatccagtgcacaagggccacgccgtgcacaaatgcacaaaacgaaatctggccgtccattttccatccaacgacatgacggcgcggggggtttttcacaaaacagactcggcaagctacggaggttgcgggagggttcatctgcatatttacgacggccgttggatggaaaatggacggccagatttcgttttgtgtatttgtgcacggcgtggcccttgtgcactggatacgatcccatttttttttttgccccgaatcctagtggacctaactggacagattacagcacgcacacgtaggcatgtcatgtagcagcactgcagtcgggtgcagtccagtccagtcctgtccagccgcgacactgtagtacatagcgatgcaacggagacacgcgttggagttggttccatctcttctcggcggccgtgccgaggcttccgcggggaagctgcgacaacagaacggaccgccgggggtgggcaggcagcaagctccctgttggcttgtgccgttgcgcagcggcgggtaccggacaacgctttcggcggcgcgcggcctcgtcggcttcccctgtttttgatgccgcctctcggtgtccggggaccgggaggatcgatggggcccgtgccgtctgatccgccacgcgagcggtcctatgcgatgcgccgcacgagcgcgggggggccgtggaacagtacacagctgggtcactcactcactcatcccgctggttgtggctgcttggttgcaacttggctcggctgtctgtctgttgcccccgccgcgttttctagccgtttccgctttgctcgcggtttcgctggcgatccggcacgcggcgcccacacccggggctggccccttggccgagtgggtggcaggcacttgcatgcatccggccggtttcccgcgaccaagctggcccgccgcaacaatgagagtgagacgagactttgtgtcagtgtgtgtatgtacatgtatgtctgcgcgacagccctaccgtccgacacgatgattcttgtgcactgtactgtactgtactaactccccccaccccctccggtatgtaacgcatgccatatgcaggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctaa

SEQ ID NO: 217 - DNA, 559 bp, Artificial Sequence
  Description of Artificial Sequence: Synthetic genome edited sequence
gtctccttccaggggagcttggccgcgaaccggtcggcgtgcgcgctcgtgtacccggacacggtgccggggacgcgccgggcgcgctgcttctcggcgagcggcagccggaagaagtcgctggcgccgtccagcgcggcgcgccccagcgccgcgtccacgccgtgcccgcacacctggaagaacccgtgcgtcgcgcacgccgcggccacctgcgccgcggcgcgccgcagccccgcgcggtcgccattgcgcagcacgcccacgtccaccatcggcacctccagctccgcggccgaggacggccgcgcctcttcctgcggccacaggaatggcgcggggatcttgggctcccggcgcaggtcgaacacggccgcgccggccttgctggccgccgcgtcggccttgtccttgccagcggggaggtcaatgctggggctgggagtgggggcgcggaggaggagcggcggggccgggctggcgtccatggacgtggctgcgcgcttggcgctgctgctgctgctgctaggcacagctggctcttgtcgttcctgcgaca

SEQ ID NO: 218 - DNA, 8800 bp, Zea mays; identical to SEQ ID NO: 182

SEQ ID NO: 219 - DNA, 1522 bp, Zea mays; identical to SEQ ID NO: 7

SEQ ID NO: 220 - DNA, 1161 bp, Zea mays; identical to SEQ ID NO: 8

SEQ ID NO: 221 - protein, 386 aa, Zea mays; identical to SEQ ID NO: 9

SEQ ID NO: 222 - DNA, 8859 bp, Zea mays; identical to SEQ ID NO: 186

SEQ ID NO: 223 - DNA, 1733 bp, Zea mays; identical to SEQ ID NO: 13

SEQ ID NO: 224 - DNA, 1392 bp, Zea mays; identical to SEQ ID NO: 14

SEQ ID NO: 225 - protein, 463 aa, Zea mays; identical to SEQ ID NO: 15

SEQ ID NO: 226 - DNA, 9067 bp, Zea mays
ggtaatggcttattggccttcactagtcggtgaaaattagctatttttataccaataaaaattagctaatatatgtaaaccaggtctaatttttatgggcctcttaccgaccaaaattgattagattattgttacaatagttttagtcaaaagctagctatgctataaaaattttgaattaaagtgagtttcgtaataaaaattgcatacttttaaaataaaataattaaaaaacagtttttagaaatacaatcaaacaccttatgctataaaaaaattgtaatgtacctacaaatatataatactttactttaaaataggcctgtgccttctcggctctatatgggctgcctccaacgaagcgccatggccatgggctccactgtgtcgggtcccacatgaggccgcgcctccctccaaatgttccctccctgccttcgtctttgtcgttgctcgcaaactccctgtcctcccctgttacaaatacccccacccgcccggacagcttccctgcatacttgcagctcgcacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcggctaccacgacggcgccgcgtcgcctgtcgtcgtggactacttcgtcggcaccctcggccaggatttcgagccaatggggtaagtaaggtagtaagaaggagcgccggtttacatttaccgcacgtcggcgtgcggtcgagtcgggactcgggagacgtatgaacccccgtcccgtcccatgcatgtgtggcaggtgggtgtaccagaggtactgcgaggagatgaaggagctgtcgctgacgatcatggagctgctggagctgagcctgggcgtggagctgcgcggctactaccgggagttcttcgaggacagccggtccatcatgcggtgcaactactacccgccgtgcccggagccggagcgcacgctgggcacgggcccgcactgcgaccccacggcgctcaccatcctcctgcaggacgacgtgggcgggctggaggtgctggtggacggtgagtggcgccccgtccggcccgtcccgggcgccatggtcatcaacatcggcgacaccttcatggtaacgaaacgaaagcgctcgctcctctgttttccttggccgctcttgtcctgtgtgtatattcagttgagctctctctgtgctgttatttcccgaatcctagtggacctaaacgggcaggttattacagcacgcacacgtaggcatgtcatgtagctagtacatacatagcgatgccgatgcaaatgcaatagagacatgcgttcgagttggttcctatctcggcgggctacggcaggtacacgcggccgcggcgcgctctctctagtctatccgcggccgcgcccaggccgatcgaggcttccgggggagagttgcgacaagagaacggaccgagggggtcggctagcggtagcaagttccctgttggtttgtggcgttggagcgttgcggagaggcttgcgcggcggcggggacgtcgacggggacgtggcggggagacgatacgatgggtgccgggcagggcaacgctttcggcgggtggccgtgtccaggtgcgcgcggccttgtcggtttccccctctcggtgtccatggccgagaaatgggtcgacgaccgagaccgacgctcggtgcggcgcccatcccgtctgatccgccgcgccacgcgagcggccctatgcgatgccgcacgggcgcggagggccgtcgcgcggagtataatgtatagtatatagtacaaggttggttggagtcgggttgggttggatcgggtcaccggtacgtggtggctgctgttgcccccgccgtttccgcttgcacttttgtcgcggtttcgctggcgatccggcacgcggcgcccacaccacgccggggctccaaacagctcgggcccttggccgtgtgggtggcaggcacttgcacgcgtccggttgtcgcggcctggcccgccgccgggcgcaccgcaacaatgagacagcccgacacgatgattcttgtgcactgtgctaacccgcatgccatgcaggcgctgtcgaacgggaggtacaagagctgcctgcaccgcgcggtggtgaaccagcggcgggcgcggcggtcgctggccttcttcctgtgcccgcgcgaggaccgggtggtgcgcccgccggccagtgctgcgccgcggcgctacccggacttcacctgggccgacctcatgcgcttcacgcagcgccactaccgcgccgacacccgcacgctggacgccttcacccgctggctctcccacggcccggcccaggcggcggcgcctccctgcacctagcgagccgggccaaggccgtctctttcgccccacgtgcgcgcccagctgggcaggtggccagacacgcggcccgcgggccccgcgccgccttgccattttttgacgctggccctactgctgtgctactagtgtacatatgcaagagtacatatatatatatatatatacgtattttctatatattatatataaaagcaaggcggcccggtgcccttctcttgttttgtccacaactgtttgatcccattattctatggaccatggatacttcaatgtttgtactaagaccgtgaacgtgggattcttttccttcctctgtgttttttctgagaaaaattaaactgatttctgtgaaatttctttgttttaacaagaaaacagaaaaattacatgaggaaaacgctccatttatttcaacaagaaaaaaatacatgaaacagaaggagaaaaaacgtgttcgttctatcattttcacacgagaaaaaaaaacatagaaaacagaaaaactccccgcgttcagatgagctcaagaaaatggaacgacacggacgtcacccgcgtcttgtagcagtgggcgcacgggtgccgaatgtttgctgggcccccaagagaatcgcttctcctcacgctgaatgaatgaatcaacgagggaaacgctgcaccctgagttccagacgtttccgaattccaaacgtttttgtggcgtgcgtccatggggcgcccccaaacttcggacgtttccggcgctccaacaaatcttctcgcttcacacgtcaccgtcgtcccggattcatttgcctcgtcgctccaccattcgctgctctcctctccacgtactcttaccctgacctttgggaaagaactgaacattcgagatgcacaacagttcaaatataacatatgcagcacaagatcgttcgactgctatccgacaagccaacaacgtgcccagtagaactgaatgtacctgtgatttccagcactaacttacagcaacgttgtgaaaaaacaaaaacgaaaacaaacggcagaaaaaacagatgtattgttctacagttacaccaaatattttctggtcctttcagcaccaacaagagccatacgcatatctagaagacaaaattcctctaatttcacccctacgtggtagcagttcctcctcaacacagttcacgtgctagcgtcgagttctttgggccgccacatcgacttctcgacgcagagcaggccctcgctgcccttggtgtaggtcatccgcacctcccactgcacggacttggccatgctctccagctcatttatcgtgtccgcggtgtccctcacgatcagcttgccctgtggcctcagtacacggtcgacctcggcgaaaactgcagccagtttgcatctgtaaacaggcaacacagatttttagtatctaaaacactgcaggcaaacgccacaggttttagtcgcaagaagcaataaaagcatgcaaacaatgctacgtgtacgtatcaaaggaacatgtcaaaactcgttgcatgaacgatcattgatgtttccttgctgaactagtcacatcagtctgcttcaacttctgggtttcactagtagatataccagaagggtagaataatgtgaagagcaagaaatacagacctctttctgagctttgagaacagatggtccgcgtgcagaaggtcatacgttcttgggtaagtgctgaaagactcgcaccagtcatggtacatgccaaacaaaccgcgctcgtagatgatgggcagcgtgtctggtgaatcgatcggcacgatattcatgacccagaccttttggtccctcagagctgcagcaaaactgccatgcaacaatgtaaagcattagtcaagaagaaggtgtacagtgcatttctccttgtcaacagtcttcagtaacaaaaaaaaagtgttatgcttgactgaatctttcaaagaaatatgcttgatgacttatggtggacaagttgcctgttatagtgttatgttttaattaactatgtgccagcttgggtaactagtagttatgtagtgtgatctgaattaccaaaatataaataaataaataaacatgcccaagaaactacgaaaaccatttacttaccctccatagacagctctcatgtccatgacatttctcactttggaccagtcaattcccatgccattcacatacgatttacttacaacccgtttccagtgggcattatctgcctcaaaatcttcatttgcaggctttccatagacaccaaccttggaaccatcaatccagaaaggggtcttctcaagcctttgcggccataactctggccattttgatcctcggacttttgagccaccaggcagtttgtgcatgcatgcttccaacggtacattcctgcaaatcaaaaggctgtgtaagcaaagcagagaagcacttttctccattgaaaatatactcttctcaaagaaccgaaaccataccaagcagcatctgcatcatcagattccttgcacaatggcgggctgttttcagatcttttctcatagcaaatattgtccattggtttctgatatatgaccataccaacttggtttaacttatccttagtcttgttgaccatcttccagcacatggactttgtcaaagtagacatggctgaaaagggtatgtggccacatgttatgttagaaataaaattcaattttgaacagttggtccatagcatgtattttgaacaaatgcaatccttctccatccatgaaagaagttgacccttcatacttaggattattcagtactttcactcatgtctgctgaatttgttctcttggtagttgctatacaagaaagggggaagtacagagtagctaaacttatacaagctatagtctgatatttgtatgaaacataaattttggtatggatgtcttattaaaatgggaggttgtataatatttttctagcctacctcaacttgcttgagactaaaaggctttgttgttgttgttgaggctgtatggtgctttgactttacaaatcaagttatcagctaccctacttatggatatacacctctcataaaatgatggtaagaagtttcgatatgtcacattaacataagaacttcattcagttagggtacaacgaagttaagtagttacggaaataccattccaaatctcaacatcctctgggagcttttggtaaacaggagtggcagaccagacaaagtaaccaccagggcgtaacaagcggttcaattccagcaaaagcatgccacctaaaagtagcgagccagcaataagattcagttctatagcaaatcaataaatgaaaggaggacatgtcaatatgtaaccagcaggacaaaccttcgatgtgccaagggaccctgcagcgagcgcaatgaatgacatcaaagactctgctggggtacggaagtctcttggtgcccatcacagctgatattgctggaattcccctttctaatgcaaattgtacttgagcttcatgctcatcttttggagcaaaagacatggtaagcgcatctctatcaaacatgtagcctccaaagctggcaactccacaaccaacatccaatatgacacggcttcgtttgccccatgcaatatcaggtagtgcctgtgaatggcagtttaatcagcatagggtgaaagcaagtgtgataacattaagttcaaagacgcaacatgaaacctcaatatcatggtacagtactcagcttatttgctatattaatgtagggatgagactaaaaaaaaggaaagttttatccgccagaatgagaggctgaaaatacagggatgactaatgttgcttagtctagcacatacaaagttacaaactgtcctcaacacctgcagatttctatatggtgctatttgacaaattatgtttgtggaatagtataacaataaatcaatcactgatgctcaaaagtgtgaggcagacaagtacaagtctaaggagtgactaatatgagatgctgggatgattataatatacctgctgaatagtatcaatatagtggagggcaccattcttgaactgagtcccacccccagggaacaagagatagtcacctgagaccttaacccaattttgatgccccttgtactctgcaagcctagtgtgaggaacattgctgtaccatacctgcaaaaaacagcacagcgtggtaataagcaaacacgcatcttggtcagctaaagatgattcggtgttgtacaattcagaataaacagaatcaccttgtccctgctctttggccactcaattggccgtttatatccttctgggagtggaacaaggcaggtaggaggctcctcagggcaatgcctctcacgatgttcataatgtttggtagttcgaagcttcttgatagccttctcgttgtcaaggcaaggtatgtaatctgttgaggcactactattacataatttccaggtatagctggttgcatcgcctgaagacttcggtaacgcttggacttccttttcattctttgactctgcagcctgtgtggggaatgaaccgttctgggtatttgactccttcagaagctctgattgggccccatcaggaaatacctcgttggagtttgagctctgatccttctctccattttcttccacgttctcttctattttaggttgctcctcctgagcggcatcgccatcaggcttctcttcttgaccgtccttactctcaccatcagttttttcatcaccactctcatttgtgatttcattgtctttcttctccacactcttctccccatcatcattcttcgtttcatctgacagcccttctgattttccatttgcgtcatcaaacatatccttggtctccgctttctctaccggcacttccagctctttctcttcaggcttctcattgaaattctcttgctcagaagcatcctgtttattcggttcctctgggactgtggcatcattgttgtcggtgtcctcaaatttctcggacccttcaccagcaatgccaggtgatgcctcctgcgacgccccgaaattgacaggcgcaggctgttgcttcaccaccggcttcttattggacgaaatctccagcgggaagacagtggacgaggtcatcatccacgcgccgactaggcagagcgccacaaagagcacgaccgtggtggttgtgcagaacgacgacgacgacgacgatgaggacggccggcggccgtccatctttccacctcggccaaatgccatcagtgcctggcgaacatgtaccagagcaccagccttcacgtggtttatctccaccaacaaccacggctggaccaacagcccccccaaaatcgcagctttgtctgccctgtgtatgctgttacgacttacgaccgcgcggcaccgaagcaaaccacaaaaaagaaactaaatcgctgcgggtttaaatcaagctgctggatctagagaaggaaacggagatctactcaagcgacaccgaaaggacggtcccggattggtgctattagcatcttgtttcctactacagcgtctctttgaagaaaagaacgcggagaaatcaccccgtaaggccaagcatggaaagaaattcagtaaagcgcgggcattaaaacccccccgtcctgctccttccgcggagagctacggcaccttccaattgagctactagctctcagctgggcgcagaacccgcactaataaatggcggattccatccagaaaaaagaagaagaagaaacagctaaataatccagcacctcgctcgcctcctcgttcgctagctcatcggcggggaaggacgggaccagctccgctggatccacgccagcaagcgggtgcaaggagagagggaacggagcagcaatgcggaggcggtaggctggtacctcgccggaaccgaccggagcggtcgcggtggccctccgagtggatctcgaggcgaggcgcgtccttgggttctctgcctccccgcactgggctcgccgcgttataaaggcaggcgggcagcgcagtggaggtgggagagtggagtgcaacctgtttgtgttagtgtgcccagagcggaagcggaggagatgggtccgcgttataaagggcctgtttggttcagcttttttctgaccagcttttttaagaatctggctgtgaggagaatctggctgtggggagaaactgagtattat

SEQ ID NO: 227 - DNA, 9067 bp, Zea mays
ataatactcagtttctccccacagccagattctcctcacagccagattcttaaaaaagctggtcagaaaaaagctgaaccaaacaggccctttataacgcggacccatctcctccgcttccgctctgggcacactaacacaaacaggttgcactccactctcccacctccactgcgctgcccgcctgcctttataacgcggcgagcccagtgcggggaggcagagaacccaaggacgcgcctcgcctcgagatccactcggagggccaccgcgaccgctccggtcggttccggcgaggtaccagcctaccgcctccgcattgctgctccgttccctctctccttgcacccgcttgctggcgtggatccagcggagctggtcccgtccttccccgccgatgagctagcgaacgaggaggcgagcgaggtgctggattatttagctgtttcttcttcttcttttttctggatggaatccgccatttattagtgcgggttctgcgcccagctgagagctagtagctcaattggaaggtgccgtagctctccgcggaaggagcaggacgggggggttttaatgcccgcgctttactgaatttctttccatgcttggccttacggggtgatttctccgcgttcttttcttcaaagagacgctgtagtaggaaacaagatgctaatagcaccaatccgggaccgtcctttcggtgtcgcttgagtagatctccgtttccttctctagatccagcagcttgatttaaacccgcagcgatttagtttcttttttgtggtttgcttcggtgccgcgcggtcgtaagtcgtaacagcatacacagggcagacaaagctgcgattttgggggggctgttggtccagccgtggttgttggtggagataaaccacgtgaaggctggtgctctggtacatgttcgccaggcactgatggcatttggccgaggtggaaagatggacggccgccggccgtcctcatcgtcgtcgtcgtcgtcgttctgcacaaccaccacggtcgtgctctttgtggcgctctgcctagtcggcgcgtggatgatgacctcgtccactgtcttcccgctggagatttcgtccaataagaagccggtggtgaagcaacagcctgcgcctgtcaatttcggggcgtcgcaggaggcatcacctggcattgctggtgaagggtccgagaaatttgaggacaccgacaacaatgatgccacagtcccagaggaaccgaataaacaggatgcttctgagcaagagaatttcaatgagaagcctgaagagaaagagctggaagtgccggtagagaaagcggagaccaaggatatgtttgatgacgcaaatggaaaatcagaagggctgtcagatgaaacgaagaatgatgatggggagaagagtgtggagaagaaagacaatgaaatcacaaatgagagtggtgatgaaaaaactgatggtgagagtaaggacggtcaagaagagaagcctgatggcgatgccgctcaggaggagcaacctaaaatagaagagaacgtggaagaaaatggagagaaggatcagagctcaaactccaacgaggtatttcctgatggggcccaatcagagcttctgaaggagtcaaatacccagaacggttcattccccacacaggctgcagagtcaaagaatgaaaaggaagtccaagcgttaccgaagtcttcaggcgatgcaaccagctatacctggaaattatgtaatagtagtgcctcaacagattacataccttgccttgacaacgagaaggctatcaagaagcttcgaactaccaaacattatgaacatcgtgagaggcattgccctgaggagcctcctacctgccttgttccactcccagaaggatataaacggccaattgagtggccaaagagcagggacaaggtgattctgtttattctgaattgtacaacaccgaatcatctttagctgaccaagatgcgtgtttgcttattaccacgctgtgctgttttttgcaggtatggtacagcaatgttcctcacactaggcttgcagagtacaaggggcatcaaaattgggttaaggtctcaggtgactatctcttgttccctgggggtgggactcagttcaagaatggtgccctccactatattgatactattcagcaggtatattataatcatcccagcatctcatattagtcactccttagacttgtacttgtctgcctcacacttttgagcatcagtgattgatttattgttatactattccacaaacataatttgtcaaatagcaccatatagaaatctgcaggtgttgaggacagtttgtaactttgtatgtgctagactaagcaacattagtcatccctgtattttcagcctctcattctggcggataaaactttccttttttttagtctcatccctacattaatatagcaaataagctgagtactgtaccatgatattgaggtttcatgttgcgtctttgaacttaatgttatcacacttgctttcaccctatgctgattaaactgccattcacaggcactacctgatattgcatggggcaaacgaagccgtgtcatattggatgttggttgtggagttgccagctttggaggctacatgtttgatagagatgcgcttaccatgtcttttgctccaaaagatgagcatgaagctcaagtacaatttgcattagaaaggggaattccagcaatatcagctgtgatgggcaccaagagacttccgtaccccagcagagtctttgatgtcattcattgcgctcgctgcagggtcccttggcacatcgaaggtttgtcctgctggttacatattgacatgtcctcctttcatttattgatttgctatagaactgaatcttattgctggctcgctacttttaggtggcatgcttttgctggaattgaaccgcttgttacgccctggtggttactttgtctggtctgccactcctgtttaccaaaagctcccagaggatgttgagatttggaatggtatttccgtaactacttaacttcgttgtaccctaactgaatgaagttcttatgttaatgtgacatatcgaaacttcttaccatcattttatgagaggtgtatatccataagtagggtagctgataacttgatttgtaaagtcaaagcaccatacagcctcaacaacaacaacaaagccttttagtctcaagcaagttgaggtaggctagaaaaatattatacaacctcccattttaataagacatccataccaaaatttatgtttcatacaaatatcagactatagcttgtataagtttagctactctgtacttccccctttcttgtatagcaactaccaagagaacaaattcagcagacatgagtgaaagtactgaataatcctaagtatgaagggtcaacttctttcatggatggagaaggattgcatttgttcaaaatacatgctatggaccaactgttcaaaattgaattttatttctaacataacatgtggccacatacccttttcagccatgtctactttgacaaagtccatgtgctggaagatggtcaacaagactaaggataagttaaaccaagttggtatggtcatatatcagaaaccaatggacaatatttgctatgagaaaagatctgaaaacagcccgccattgtgcaaggaatctgatgatgcagatgctgcttggtatggtttcggttctttgagaagagtatattttcaatggagaaaagtgcttctctgctttgcttacacagccttttgatttgcaggaatgtaccgttggaagcatgcatgcacaaactgcctggtggctcaaaagtccgaggatcaaaatggccagagttatggccgcaaaggcttgagaagacccctttctggattgatggttccaaggttggtgtctatggaaagcctgcaaatgaagattttgaggcagataatgcccactggaaacgggttgtaagtaaatcgtatgtgaatggcatgggaattgactggtccaaagtgagaaatgtcatggacatgagagctgtctatggagggtaagtaaatggttttcgtagtttcttgggcatgtttatttatttatttatattttggtaattcagatcacactacataactactagttacccaagctggcacatagttaattaaaacataacactataacaggcaacttgtccaccataagtcatcaagcatatttctttgaaagattcagtcaagcataacactttttttttgttactgaagactgttgacaaggagaaatgcactgtacaccttcttcttgactaatgctttacattgttgcatggcagttttgctgcagctctgagggaccaaaaggtctgggtcatgaatatcgtgccgatcgattcaccagacacgctgcccatcatctacgagcgcggtttgtttggcatgtaccatgactggtgcgagtctttcagcacttacccaagaacgtatgaccttctgcacgcggaccatctgttctcaaagctcagaaagaggtctgtatttcttgctcttcacattattctacccttctggtatatctactagtgaaacccagaagttgaagcagactgatgtgactagttcagcaaggaaacatcaatgatcgttcatgcaacgagttttgacatgttcctttgatacgtacacgtagcattgtttgcatgcttttattgcttcttgcgactaaaacctgtggcgtttgcctgcagtgttttagatactaaaaatctgtgttgcctgtttacagatgcaaactggctgcagttttcgccgaggtcgaccgtgtactgaggccacagggcaagctgatcgtgagggacaccgcggacacgataaatgagctggagagcatggccaagtccgtgcagtgggaggtgcggatgacctacaccaagggcagcgagggcctgctctgcgtcgagaagtcgatgtggcggcccaaagaactcgacgctagcacgtgaactgtgttgaggaggaactgctaccacgtaggggtgaaattagaggaattttgtcttctagatatgcgtatggctcttgttggtgctgaaaggaccagaaaatatttggtgtaactgtagaacaatacatctgttttttctgccgtttgttttcgtttttgttttttcacaacgttgctgtaagttagtgctggaaatcacaggtacattcagttctactgggcacgttgttggcttgtcggatagcagtcgaacgatcttgtgctgcatatgttatatttgaactgttgtgcatctcgaatgttcagttctttcccaaaggtcagggtaagagtacgtggagaggagagcagcgaatggtggagcgacgaggcaaatgaatccgggacgacggtgacgtgtgaagcgagaagatttgttggagcgccggaaacgtccgaagtttgggggcgccccatggacgcacgccacaaaaacgtttggaattcggaaacgtctggaactcagggtgcagcgtttccctcgttgattcattcattcagcgtgaggagaagcgattctcttgggggcccagcaaacattcggcacccgtgcgcccactgctacaagacgcgggtgacgtccgtgtcgttccattttcttgagctcatctgaacgcggggagtttttctgttttctatgtttttttttctcgtgtgaaaatgatagaacgaacacgttttttctccttctgtttcatgtatttttttcttgttgaaataaatggagcgttttcctcatgtaatttttctgttttcttgttaaaacaaagaaatttcacagaaatcagtttaatttttctcagaaaaaacacagaggaaggaaaagaatcccacgttcacggtcttagtacaaacattgaagtatccatggtccatagaataatgggatcaaacagttgtggacaaaacaagagaagggcaccgggccgccttgcttttatatataatatatagaaaatacgtatatatatatatatatatgtactcttgcatatgtacactagtagcacagcagtagggccagcgtcaaaaaatggcaaggcggcgcggggcccgcgggccgcgtgtctggccacctgcccagctgggcgcgcacgtggggcgaaagagacggccttggcccggctcgctaggtgcagggaggcgccgccgcctgggccgggccgtgggagagccagcgggtgaaggcgtccagcgtgcgggtgtcggcgcggtagtggcgctgcgtgaagcgcatgaggtcggcccaggtgaagtccgggtagcgccgcggcgcagcactggccggcgggcgcaccacccggtcctcgcgcgggcacaggaagaaggccagcgaccgccgcgcccgccgctggttcaccaccgcgcggtgcaggcagctcttgtacctcccgttcgacagcgcctgcatggcatgcgggttagcacagtgcacaagaatcatcgtgtcgggctgtctcattgttgcggtgcgcccggcggcgggccaggccgcgacaaccggacgcgtgcaagtgcctgccacccacacggccaagggcccgagctgtttggagccccggcgtggtgtgggcgccgcgtgccggatcgccagcgaaaccgcgacaaaagtgcaagcggaaacggcgggggcaacagcagccaccacgtaccggtgacccgatccaacccaacccgactccaaccaaccttgtactatatactatacattatactccgcgcgacggccctccgcgcccgtgcggcatcgcatagggccgctcgcgtggcgcggcggatcagacgggatgggcgccgcaccgagcgtcggtctcggtcgtcgacccatttctcggccatggacaccgagagggggaaaccgacaaggccgcgcgcacctggacacggccacccgccgaaagcgttgccctgcccggcacccatcgtatcgtctccccgccacgtccccgtcgacgtccccgccgccgcgcaagcctctccgcaacgctccaacgccacaaaccaacagggaacttgctaccgctagccgaccccctcggtccgttctcttgtcgcaactctcccccggaagcctcgatcggcctgggcgcggccgcggatagactagagagagcgcgccgcggccgcgtgtacctgccgtagcccgccgagataggaaccaactcgaacgcatgtctctattgcatttgcatcggcatcgctatgtatgtactagctacatgacatgcctacgtgtgcgtgctgtaataacctgcccgtttaggtccactaggattcgggaaataacagcacagagagagctcaactgaatatacacacaggacaagagcggccaaggaaaacagaggagcgagcgctttcgtttcgttaccatgaaggtgtcgccgatgttgatgaccatggcgcccgggacgggccggacggggcgccactcaccgtccaccagcacctccagcccgcccacgtcgtcctgcaggaggatggtgagcgccgtggggtcgcagtgcgggcccgtgcccagcgtgcgctccggctccgggcacggcgggtagtagttgcaccgcatgatggaccggctgtcctcgaagaactcccggtagtagccgcgcagctccacgcccaggctcagctccagcagctccatgatcgtcagcgacagctccttcatctcctcgcagtacctctggtacacccacctgccacacatgcatgggacgggacgggggttcatacgtctcccgagtcccgactcgaccgcacgccgacgtgcggtaaatgtaaaccggcgctccttcttactaccttacttaccccattggctcgaaatcctggccgagggtgccgacgaagtagtccacgacgacaggcgacgcggcgccgtcgtggtagccgaacgacagggtctccttccaggggagcttggccgcgaaccggtcggcgtgcgcgctcgtgtacccggacacggtgccggggacgcgccgggcgcgctgcttctcggcgagcggcagccggaagaagtcgctggcgccgtccagcgcggcgcgccccagcgccgcgtccacgccgtgcccgcacacctggaagaacccgtgcgtcgcgcacgccgcggccacctgcgccgcggcgcgccgcagccccgcgcggtcgccattgcgcagcacgcccacgtccaccatcggcacctccagctccgcggccgaggacggccgcgcctcttcctgcggccacaggaatggcgcggggatcttgggctcccggcgcaggtcgaacacggccgcgccggccttgctggccgccgcgtcggccttgtccttgccagcggggaggtcaatgctggggctgggagtgggggcgcggaggaggagcggcggggccgggctggcgtccatggacgtggctgcgcgcttggcgctgctgctgctgctgctaggcacagctggctcttgtcgttcctgcgacaccatgagatgtgcgagctgcaagtatgcagggaagctgtccgggcgggtgggggtatttgtaacaggggaggacagggagtttgcgagcaacgacaaagacgaaggcagggagggaacatttggagggaggcgcggcctcatgtgggacccgacacagtggagcccatggccatggcgcttcgttggaggcagcccatatagagccgagaaggcacaggcctattttaaagtaaagtattatatatttgtaggtacattacaatttttttatagcataaggtgtttgattgtatttctaaaaactgttttttaattattttattttaaaagtatgcaatttttattacgaaactcactttaattcaaaatttttatagcatagctagcttttgactaaaactattgtaacaataatctaatcaattttggtcggtaagaggcccataaaaattagacctggtttacatatattagctaatttttattggtataaaaatagctaattttcaccgactagtgaaggccaataagccattacc

SEQ ID NO: 228 - DNA, 398 bp, Zea mays
ggtaatggcttattggccttcactagtcggtgaaaattagctatttttataccaataaaaattagctaatatatgtaaaccaggtctaatttttatgggcctcttaccgaccaaaattgattagattattgttacaatagttttagtcaaaagctagctatgctataaaaattttgaattaaagtgagtttcgtaataaaaattgcatacttttaaaataaaataattaaaaaacagtttttagaaatacaatcaaacaccttatgctataaaaaaattgtaatgtacctacaaatatataatactttactttaaaataggcctgtgccttctcggctctatatgggctgcctccaacgaagcgccatggccatgggctccactgtgtcgggtcccac

SEQ ID NO: 229 - DNA, 791 bp, Zea mays
atgaggccgcgcctccctccaaatgttccctccctgccttcgtctttgtcgttgctcgcaaactccctgtcctcccctgttacaaatacccccacccgcccggacagcttccctgcatacttgcagctcgcacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcggctaccacgacggcgccgcgtcgcctgtcgtcgtggactacttcgtcggcaccctcggccaggatttcgagccaatggg

SEQ ID NO: 230 - DNA, 115 bp, Zea mays
gtaagtaaggtagtaagaaggagcgccggtttacatttaccgcacgtcggcgtgcggtcgagtcgggactcgggagacgtatgaacccccgtcccgtcccatgcatgtgtggcag

SEQ ID NO: 231 - DNA, 325 bp, Zea mays
gtgggtgtaccagaggtactgcgaggagatgaaggagctgtcgctgacgatcatggagctgctggagctgagcctgggcgtggagctgcgcggctactaccgggagttcttcgaggacagccggtccatcatgcggtgcaactactacccgccgtgcccggagccggagcgcacgctgggcacgggcccgcactgcgaccccacggcgctcaccatcctcctgcaggacgacgtgggcgggctggaggtgctggtggacggtgagtggcgccccgtccggcccgtcccgggcgccatggtcatcaacatcggcgacaccttcatg

SEQ ID NO: 232 - DNA, 966 bp, Zea mays
gtaacgaaacgaaagcgctcgctcctctgttttccttggccgctcttgtcctgtgtgtatattcagttgagctctctctgtgctgttatttcccgaatcctagtggacctaaacgggcaggttattacagcacgcacacgtaggcatgtcatgtagctagtacatacatagcgatgccgatgcaaatgcaatagagacatgcgttcgagttggttcctatctcggcgggctacggcaggtacacgcggccgcggcgcgctctctctagtctatccgcggccgcgcccaggccgatcgaggcttccgggggagagttgcgacaagagaacggaccgagggggtcggctagcggtagcaagttccctgttggtttgtggcgttggagcgttgcggagaggcttgcgcggcggcggggacgtcgacggggacgtggcggggagacgatacgatgggtgccgggcagggcaacgctttcggcgggtggccgtgtccaggtgcgcgcggccttgtcggtttccccctctcggtgtccatggccgagaaatgggtcgacgaccgagaccgacgctcggtgcggcgcccatcccgtctgatccgccgcgccacgcgagcggccctatgcgatgccgcacgggcgcggagggccgtcgcgcggagtataatgtatagtatatagtacaaggttggttggagtcgggttgggttggatcgggtcaccggtacgtggtggctgctgttgcccccgccgtttccgcttgcacttttgtcgcggtttcgctggcgatccggcacgcggcgcccacaccacgccggggctccaaacagctcgggcccttggccgtgtgggtggcaggcacttgcacgcgtccggttgtcgcggcctggcccgccgccgggcgcaccgcaacaatgagacagcccgacacgatgattcttgtgcactgtgctaacccgcatgccatgcag

SEQ ID NO: 233 - DNA, 276 bp, Zea mays
gcgctgtcgaacgggaggtacaagagctgcctgcaccgcgcggtggtgaaccagcggcgggcgcggcggtcgctggccttcttcctgtgcccgcgcgaggaccgggtggtgcgcccgccggccagtgctgcgccgcggcgctacccggacttcacctgggccgacctcatgcgcttcacgcagcgccactaccgcgccgacacccgcacgctggacgccttcacccgctggctctcccacggcccggcccaggcggcggcgcctccctgcacctag

SEQ ID NO: 234 - DNA, 309 bp, Zea mays
cgagccgggccaaggccgtctctttcgccccacgtgcgcgcccagctgggcaggtggccagacacgcggcccgcgggccccgcgccgccttgccattttttgacgctggccctactgctgtgctactagtgtacatatgcaagagtacatatatatatatatatatacgtattttctatatattatatataaaagcaaggcggcccggtgcccttctcttgttttgtccacaactgtttgatcccattattctatggaccatggatacttcaatgtttgtactaagaccgtgaacgtgggattcttttc

SEQ ID NO: 235 - DNA, 556 bp, Zea mays
cttcctctgtgttttttctgagaaaaattaaactgatttctgtgaaatttctttgttttaacaagaaaacagaaaaattacatgaggaaaacgctccatttatttcaacaagaaaaaaatacatgaaacagaaggagaaaaaacgtgttcgttctatcattttcacacgagaaaaaaaaacatagaaaacagaaaaactccccgcgttcagatgagctcaagaaaatggaacgacacggacgtcacccgcgtcttgtagcagtgggcgcacgggtgccgaatgtttgctgggcccccaagagaatcgcttctcctcacgctgaatgaatgaatcaacgagggaaacgctgcaccctgagttccagacgtttccgaattccaaacgtttttgtggcgtgcgtccatggggcgcccccaaacttcggacgtttccggcgctccaacaaatcttctcgcttcacacgtcaccgtcgtcccggattcatttgcctcgtcgctccaccattcgctgctctcctctccacgtactcttaccctgacctttgggaaagaactg

SEQ ID NO: 236 - DNA, 405 bp, Zea mays
aacattcgagatgcacaacagttcaaatataacatatgcagcacaagatcgttcgactgctatccgacaagccaacaacgtgcccagtagaactgaatgtacctgtgatttccagcactaacttacagcaacgttgtgaaaaaacaaaaacgaaaacaaacggcagaaaaaacagatgtattgttctacagttacaccaaatattttctggtcctttcagcaccaacaagagccatacgcatatctagaagacaaaattcctctaatttcacccctacgtggtagcagttcctcctcaacacagttcacgtgctagcgtcgagttctttgggccgccacatcgacttctcgacgcagagcaggccctcgctgcccttggtgtaggtcatccgcacctcccactgc

SEQ ID NO: 237 - DNA, 217 bp, Zea mays
tcacgtgctagcgtcgagttctttgggccgccacatcgacttctcgacgcagagcaggccctcgctgcccttggtgtaggtcatccgcacctcccactgcacggacttggccatgctctccagctcatttatcgtgtccgcggtgtccctcacgatcagcttgccctgtggcctcagtacacggtcgacctcggcgaaaactgcagccagtttgcat

SEQ ID NO: 238 - DNA, 254 bp, Zea mays
ctgtaaacaggcaacacagatttttagtatctaaaacactgcaggcaaacgccacaggttttagtcgcaagaagcaataaaagcatgcaaacaatgctacgtgtacgtatcaaaggaacatgtcaaaactcgttgcatgaacgatcattgatgtttccttgctgaactagtcacatcagtctgcttcaacttctgggtttcactagtagatataccagaagggtagaataatgtgaagagcaagaaatacagac

SEQ ID NO: 239 - DNA, 195 bp, Zea mays
ctctttctgagctttgagaacagatggtccgcgtgcagaaggtcatacgttcttgggtaagtgctgaaagactcgcaccagtcatggtacatgccaaacaaaccgcgctcgtagatgatgggcagcgtgtctggtgaatcgatcggcacgatattcatgacccagaccttttggtccctcagagctgcagcaaaa

SEQ ID NO: 240 - DNA, 282 bp, Zea mays
ctgccatgcaacaatgtaaagcattagtcaagaagaaggtgtacagtgcatttctccttgtcaacagtcttcagtaacaaaaaaaaagtgttatgcttgactgaatctttcaaagaaatatgcttgatgacttatggtggacaagttgcctgttatagtgttatgttttaattaactatgtgccagcttgggtaactagtagttatgtagtgtgatctgaattaccaaaatataaataaataaataaacatgcccaagaaactacgaaaaccatttacttac

SEQ ID NO: 241 - DNA, 273 bp, Zea mays
cctccatagacagctctcatgtccatgacatttctcactttggaccagtcaattcccatgccattcacatacgatttacttacaacccgtttccagtgggcattatctgcctcaaaatcttcatttgcaggctttccatagacaccaaccttggaaccatcaatccagaaaggggtcttctcaagcctttgcggccataactctggccattttgatcctcggacttttgagccaccaggcagtttgtgcatgcatgcttccaacggtacattc

SEQ ID NO: 242 - DNA, 86 bp, Zea mays
ctgcaaatcaaaaggctgtgtaagcaaagcagagaagcacttttctccattgaaaatatactcttctcaaagaaccgaaaccatac

SEQ ID NO: 243 - DNA, 175 bp, Zea mays
caagcagcatctgcatcatcagattccttgcacaatggcgggctgttttcagatcttttctcatagcaaatattgtccattggtttctgatatatgaccataccaacttggtttaacttatccttagtcttgttgaccatcttccagcacatggactttgtcaaagtagacatgg

SEQ ID NO: 244 - DNA, 514 bp, Zea mays
ctgaaaagggtatgtggccacatgttatgttagaaataaaattcaattttgaacagttggtccatagcatgtattttgaacaaatgcaatccttctccatccatgaaagaagttgacccttcatacttaggattattcagtactttcactcatgtctgctgaatttgttctcttggtagttgctatacaagaaagggggaagtacagagtagctaaacttatacaagctatagtctgatatttgtatgaaacataaattttggtatggatgtcttattaaaatgggaggttgtataatatttttctagcctacctcaacttgcttgagactaaaaggctttgttgttgttgttgaggctgtatggtgctttgactttacaaatcaagttatcagctaccctacttatggatatacacctctcataaaatgatggtaagaagtttcgatatgtcacattaacataagaacttcattcagttagggtacaacgaagttaagtagttacggaaatac

SEQ ID NO: 245 - DNA, 111 bp, Zea mays
cattccaaatctcaacatcctctgggagcttttggtaaacaggagtggcagaccagacaaagtaaccaccagggcgtaacaagcggttcaattccagcaaaagcatgccac

SEQ ID NO: 246 - DNA, 111 bp, Zea mays
ttccagcaaaagcatgccacctaaaagtagcgagccagcaataagattcagttctatagcaaatcaataaatgaaaggaggacatgtcaatatgtaaccagcaggacaaac

SEQ ID NO: 247 - DNA, 271 bp, Zea mays
cttcgatgtgccaagggaccctgcagcgagcgcaatgaatgacatcaaagactctgctggggtacggaagtctcttggtgcccatcacagctgatattgctggaattcccctttctaatgcaaattgtacttgagcttcatgctcatcttttggagcaaaagacatggtaagcgcatctctatcaaacatgtagcctccaaagctggcaactccacaaccaacatccaatatgacacggcttcgtttgccccatgcaatatcaggtagtgc

SEQ ID NO: 248 - DNA, 384 bp, Zea mays
ctgtgaatggcagtttaatcagcatagggtgaaagcaagtgtgataacattaagttcaaagacgcaacatgaaacctcaatatcatggtacagtactcagcttatttgctatattaatgtagggatgagactaaaaaaaaggaaagttttatccgccagaatgagaggctgaaaatacagggatgactaatgttgcttagtctagcacatacaaagttacaaactgtcctcaacacctgcagatttctatatggtgctatttgacaaattatgtttgtggaatagtataacaataaatcaatcactgatgctcaaaagtgtgaggcagacaagtacaagtctaaggagtgactaatatgagatgctgggatgattataatatac

SEQ ID NO: 249 - DNA, 150 bp, Zea mays
ctgctgaatagtatcaatatagtggagggcaccattcttgaactgagtcccacccccagggaacaagagatagtcacctgagaccttaacccaattttgatgccccttgtactctgcaagcctagtgtgaggaacattgctgtaccatac

SEQ ID NO: 250 - DNA, 95 bp, Zea mays
ctgcaaaaaacagcacagcgtggtaataagcaaacacgcatcttggtcagctaaagatgattcggtgttgtacaattcagaataaacagaatcac

SEQ ID NO: 251 - DNA, 987 bp, Zea mays
cttgtccctgctctttggccactcaattggccgtttatatccttctgggagtggaacaaggcaggtaggaggctcctcagggcaatgcctctcacgatgttcataatgtttggtagttcgaagcttcttgatagccttctcgttgtcaaggcaaggtatgtaatctgttgaggcactactattacataatttccaggtatagctggttgcatcgcctgaagacttcggtaacgcttggacttccttttcattctttgactctgcagcctgtgtggggaatgaaccgttctgggtatttgactccttcagaagctctgattgggccccatcaggaaatacctcgttggagtttgagctctgatccttctctccattttcttccacgttctcttctattttaggttgctcctcctgagcggcatcgccatcaggcttctcttcttgaccgtccttactctcaccatcagttttttcatcaccactctcatttgtgatttcattgtctttcttctccacactcttctccccatcatcattcttcgtttcatctgacagcccttctgattttccatttgcgtcatcaaacatatccttggtctccgctttctctaccggcacttccagctctttctcttcaggcttctcattgaaattctcttgctcagaagcatcctgtttattcggttcctctgggactgtggcatcattgttgtcggtgtcctcaaatttctcggacccttcaccagcaatgccaggtgatgcctcctgcgacgccccgaaattgacaggcgcaggctgttgcttcaccaccggcttcttattggacgaaatctccagcgggaagacagtggacgaggtcatcatccacgcgccgactaggcagagcgccacaaagagcacgaccgtggtggttgtgcagaacgacgacgacgacgacgatgaggacggccggcggccgtccatctttccacctcggccaaatgccat

SEQ ID NO: 252 - DNA, 142 bp, Zea mays
cagtgcctggcgaacatgtaccagagcaccagccttcacgtggtttatctccaccaacaaccacggctggaccaacagcccccccaaaatcgcagctttgtctgccctgtgtatgctgttacgacttacgaccgcgcggcac

SEQ ID NO: 253 - DNA, 503 bp, Zea mays
cgaagcaaaccacaaaaaagaaactaaatcgctgcgggtttaaatcaagctgctggatctagagaaggaaacggagatctactcaagcgacaccgaaaggacggtcccggattggtgctattagcatcttgtttcctactacagcgtctctttgaagaaaagaacgcggagaaatcaccccgtaaggccaagcatggaaagaaattcagtaaagcgcgggcattaaaacccccccgtcctgctccttccgcggagagctacggcaccttccaattgagctactagctctcagctgggcgcagaacccgcactaataaatggcggattccatccagaaaaaagaagaagaagaaacagctaaataatccagcacctcgctcgcctcctcgttcgctagctcatcggcggggaaggacgggaccagctccgctggatccacgccagcaagcgggtgcaaggagagagggaacggagcagcaatgcggaggcggtaggctggtacc

SEQ ID NO: 254 - DNA, 171 bp, Zea mays
tcgccggaaccgaccggagcggtcgcggtggccctccgagtggatctcgaggcgaggcgcgtccttgggttctctgcctccccgcactgggctcgccgcgttataaaggcaggcgggcagcgcagtggaggtgggagagtggagtgcaacctgtttgtgttagtgtgccca

SEQ ID NO: 255 - DNA, 125 bp, Zea mays
gagcggaagcggaggagatgggtccgcgttataaagggcctgtttggttcagcttttttctgaccagcttttttaagaatctggctgtgaggagaatctggctgtggggagaaactgagtattat

SEQ ID NO: 256 - DNA, 125 bp, Zea mays
ataatactcagtttctccccacagccagattctcctcacagccagattcttaaaaaagctggtcagaaaaaagctgaaccaaacaggccctttataacgcggacccatctcctccgcttccgctc

SEQ ID NO: 257 - DNA, 171 bp, Zea mays
tgggcacactaacacaaacaggttgcactccactctcccacctccactgcgctgcccgcctgcctttataacgcggcgagcccagtgcggggaggcagagaacccaaggacgcgcctcgcctcgagatccactcggagggccaccgcgaccgctccggtcggttccggcga

SEQ ID NO: 258 - DNA, 503 bp, Zea mays
ggtaccagcctaccgcctccgcattgctgctccgttccctctctccttgcacccgcttgctggcgtggatccagcggagctggtcccgtccttccccgccgatgagctagcgaacgaggaggcgagcgaggtgctggattatttagctgtttcttcttcttcttttttctggatggaatccgccatttattagtgcgggttctgcgcccagctgagagctagtagctcaattggaaggtgccgtagctctccgcggaaggagcaggacgggggggttttaatgcccgcgctttactgaatttctttccatgcttggccttacggggtgatttctccgcgttcttttcttcaaagagacgctgtagtaggaaacaagatgctaatagcaccaatccgggaccgtcctttcggtgtcgcttgagtagatctccgtttccttctctagatccagcagcttgatttaaacccgcagcgatttagtttcttttttgtggtttgcttcg

SEQ ID NO: 259 - DNA, 142 bp, Zea mays
gtgccgcgcggtcgtaagtcgtaacagcatacacagggcagacaaagctgcgattttgggggggctgttggtccagccgtggttgttggtggagataaaccacgtgaaggctggtgctctggtacatgttcgccaggcactg

SEQ ID NO: 260 - DNA, 987 bp, Zea mays
atggcatttggccgaggtggaaagatggacggccgccggccgtcctcatcgtcgtcgtcgtcgtcgttctgcacaaccaccacggtcgtgctctttgtggcgctctgcctagtcggcgcgtggatgatgacctcgtccactgtcttcccgctggagatttcgtccaataagaagccggtggtgaagcaacagcctgcgcctgtcaatttcggggcgtcgcaggaggcatcacctggcattgctggtgaagggtccgagaaatttgaggacaccgacaacaatgatgccacagtcccagaggaaccgaataaacaggatgcttctgagcaagagaatttcaatgagaagcctgaagagaaagagctggaagtgccggtagagaaagcggagaccaaggatatgtttgatgacgcaaatggaaaatcagaagggctgtcagatgaaacgaagaatgatgatggggagaagagtgtggagaagaaagacaatgaaatcacaaatgagagtggtgatgaaaaaactgatggtgagagtaaggacggtcaagaagagaagcctgatggcgatgccgctcaggaggagcaacctaaaatagaagagaacgtggaagaaaatggagagaaggatcagagctcaaactccaacgaggtatttcctgatggggcccaatcagagcttctgaaggagtcaaatacccagaacggttcattccccacacaggctgcagagtcaaagaatgaaaaggaagtccaagcgttaccgaagtcttcaggcgatgcaaccagctatacctggaaattatgtaatagtagtgcctcaacagattacataccttgccttgacaacgagaaggctatcaagaagcttcgaactaccaaacattatgaacatcgtgagaggcattgccctgaggagcctcctacctgccttgttccactcccagaaggatataaacggccaattgagtggccaaagagcagggacaag

SEQ ID NO: 261 - DNA, 95 bp, Zea mays
gtgattctgtttattctgaattgtacaacaccgaatcatctttagctgaccaagatgcgtgtttgcttattaccacgctgtgctgttttttgcag

SEQ ID NO: 262 - DNA, 150 bp, Zea mays
gtatggtacagcaatgttcctcacactaggcttgcagagtacaaggggcatcaaaattgggttaaggtctcaggtgactatctcttgttccctgggggtgggactcagttcaagaatggtgccctccactatattgatactattcagcag

SEQ ID NO: 263 - DNA, 384 bp, Zea mays
gtatattataatcatcccagcatctcatattagtcactccttagacttgtacttgtctgcctcacacttttgagcatcagtgattgatttattgttatactattccacaaacataatttgtcaaatagcaccatatagaaatctgcaggtgttgaggacagtttgtaactttgtatgtgctagactaagcaacattagtcatccctgtattttcagcctctcattctggcggataaaactttccttttttttagtctcatccctacattaatatagcaaataagctgagtactgtaccatgatattgaggtttcatgttgcgtctttgaacttaatgttatcacacttgctttcaccctatgctgattaaactgccattcacag

SEQ ID NO: 264 - DNA, 271 bp, Zea mays
gcactacctgatattgcatggggcaaacgaagccgtgtcatattggatgttggttgtggagttgccagctttggaggctacatgtttgatagagatgcgcttaccatgtcttttgctccaaaagatgagcatgaagctcaagtacaatttgcattagaaaggggaattccagcaatatcagctgtgatgggcaccaagagacttccgtaccccagcagagtctttgatgtcattcattgcgctcgctgcagggtcccttggcacatcgaag

SEQ ID NO: 265 - DNA, 111 bp, Zea mays
gtttgtcctgctggttacatattgacatgtcctcctttcatttattgatttgctatagaactgaatcttattgctggctcgctacttttaggtggcatgcttttgctggaa

SEQ ID NO: 266 - DNA, 111 bp, Zea mays
gtggcatgcttttgctggaattgaaccgcttgttacgccctggtggttactttgtctggtctgccactcctgtttaccaaaagctcccagaggatgttgagatttggaatg

SEQ ID NO: 267 - DNA, 514 bp, Zea mays
gtatttccgtaactacttaacttcgttgtaccctaactgaatgaagttcttatgttaatgtgacatatcgaaacttcttaccatcattttatgagaggtgtatatccataagtagggtagctgataacttgatttgtaaagtcaaagcaccatacagcctcaacaacaacaacaaagccttttagtctcaagcaagttgaggtaggctagaaaaatattatacaacctcccattttaataagacatccataccaaaatttatgtttcatacaaatatcagactatagcttgtataagtttagctactctgtacttccccctttcttgtatagcaactaccaagagaacaaattcagcagacatgagtgaaagtactgaataatcctaagtatgaagggtcaacttctttcatggatggagaaggattgcatttgttcaaaatacatgctatggaccaactgttcaaaattgaattttatttctaacataacatgtggccacatacccttttcag

SEQ ID NO: 268 - DNA, 175 bp, Zea mays
ccatgtctactttgacaaagtccatgtgctggaagatggtcaacaagactaaggataagttaaaccaagttggtatggtcatatatcagaaaccaatggacaatatttgctatgagaaaagatctgaaaacagcccgccattgtgcaaggaatctgatgatgcagatgctgcttg

SEQ ID NO: 269 - DNA, 86 bp, Zea mays
gtatggtttcggttctttgagaagagtatattttcaatggagaaaagtgcttctctgctttgcttacacagccttttgatttgcag

SEQ ID NO: 270 - DNA, 273 bp, Zea mays
gaatgtaccgttggaagcatgcatgcacaaactgcctggtggctcaaaagtccgaggatcaaaatggccagagttatggccgcaaaggcttgagaagacccctttctggattgatggttccaaggttggtgtctatggaaagcctgcaaatgaagattttgaggcagataatgcccactggaaacgggttgtaagtaaatcgtatgtgaatggcatgggaattgactggtccaaagtgagaaatgtcatggacatgagagctgtctatggagg

SEQ ID NO: 271 - DNA, 282 bp, Zea mays
gtaagtaaatggttttcgtagtttcttgggcatgtttatttatttatttatattttggtaattcagatcacactacataactactagttacccaagctggcacatagttaattaaaacataacactataacaggcaacttgtccaccataagtcatcaagcatatttctttgaaagattcagtcaagcataacactttttttttgttactgaagactgttgacaaggagaaatgcactgtacaccttcttcttgactaatgctttacattgttgcatggcag

SEQ ID NO: 272 - DNA, 195 bp, Zea mays
ttttgctgcagctctgagggaccaaaaggtctgggtcatgaatatcgtgccgatcgattcaccagacacgctgcccatcatctacgagcgcggtttgtttggcatgtaccatgactggtgcgagtctttcagcacttacccaagaacgtatgaccttctgcacgcggaccatctgttctcaaagctcagaaagag

SEQ ID NO: 273 - DNA, 254 bp, Zea mays
gtctgtatttcttgctcttcacattattctacccttctggtatatctactagtgaaacccagaagttgaagcagactgatgtgactagttcagcaaggaaacatcaatgatcgttcatgcaacgagttttgacatgttcctttgatacgtacacgtagcattgtttgcatgcttttattgcttcttgcgactaaaacctgtggcgtttgcctgcagtgttttagatactaaaaatctgtgttgcctgtttacag

SEQ ID NO: 274 - DNA, 217 bp, Zea mays
atgcaaactggctgcagttttcgccgaggtcgaccgtgtactgaggccacagggcaagctgatcgtgagggacaccgcggacacgataaatgagctggagagcatggccaagtccgtgcagtgggaggtgcggatgacctacaccaagggcagcgagggcctgctctgcgtcgagaagtcgatgtggcggcccaaagaactcgacgctagcacgtga

SEQ ID NO: 275 - DNA, 405 bp, Zea mays
gcagtgggaggtgcggatgacctacaccaagggcagcgagggcctgctctgcgtcgagaagtcgatgtggcggcccaaagaactcgacgctagcacgtgaactgtgttgaggaggaactgctaccacgtaggggtgaaattagaggaattttgtcttctagatatgcgtatggctcttgttggtgctgaaaggaccagaaaatatttggtgtaactgtagaacaatacatctgttttttctgccgtttgttttcgtttttgttttttcacaacgttgctgtaagttagtgctggaaatcacaggtacattcagttctactgggcacgttgttggcttgtcggatagcagtcgaacgatcttgtgctgcatatgttatatttgaactgttgtgcatctcgaatgtt

SEQ ID NO: 276 - DNA, 556 bp, Zea mays
cagttctttcccaaaggtcagggtaagagtacgtggagaggagagcagcgaatggtggagcgacgaggcaaatgaatccgggacgacggtgacgtgtgaagcgagaagatttgttggagcgccggaaacgtccgaagtttgggggcgccccatggacgcacgccacaaaaacgtttggaattcggaaacgtctggaactcagggtgcagcgtttccctcgttgattcattcattcagcgtgaggagaagcgattctcttgggggcccagcaaacattcggcacccgtgcgcccactgctacaagacgcgggtgacgtccgtgtcgttccattttcttgagctcatctgaacgcggggagtttttctgttttctatgtttttttttctcgtgtgaaaatgatagaacgaacacgttttttctccttctgtttcatgtatttttttcttgttgaaataaatggagcgttttcctcatgtaatttttctgttttcttgttaaaacaaagaaatttcacagaaatcagtttaatttttctcagaaaaaacacagaggaag

SEQ ID NO: 277 - DNA, 309 bp, Zea mays
gaaaagaatcccacgttcacggtcttagtacaaacattgaagtatccatggtccatagaataatgggatcaaacagttgtggacaaaacaagagaagggcaccgggccgccttgcttttatatataatatatagaaaatacgtatatatatatatatatatgtactcttgcatatgtacactagtagcacagcagtagggccagcgtcaaaaaatggcaaggcggcgcggggcccgcgggccgcgtgtctggccacctgcccagctgggcgcgcacgtggggcgaaagagacggccttggcccggctcg

SEQ ID NO: 278 - DNA, 276 bp, Zea mays
ctaggtgcagggaggcgccgccgcctgggccgggccgtgggagagccagcgggtgaaggcgtccagcgtgcgggtgtcggcgcggtagtggcgctgcgtgaagcgcatgaggtcggcccaggtgaagtccgggtagcgccgcggcgcagcactggccggcgggcgcaccacccggtcctcgcgcgggcacaggaagaaggccagcgaccgccgcgcccgccgctggttcaccaccgcgcggtgcaggcagctcttgtacctcccgttcgacagcgc

SEQ ID NO: 279 - DNA, 966 bp, Zea mays
ctgcatggcatgcgggttagcacagtgcacaagaatcatcgtgtcgggctgtctcattgttgcggtgcgcccggcggcgggccaggccgcgacaaccggacgcgtgcaagtgcctgccacccacacggccaagggcccgagctgtttggagccccggcgtggtgtgggcgccgcgtgccggatcgccagcgaaaccgcgacaaaagtgcaagcggaaacggcgggggcaacagcagccaccacgtaccggtgacccgatccaacccaacccgactccaaccaaccttgtactatatactatacattatactccgcgcgacggccctccgcgcccgtgcggcatcgcatagggccgctcgcgtggcgcggcggatcagacgggatgggcgccgcaccgagcgtcggtctcggtcgtcgacccatttctcggccatggacaccgagagggggaaaccgacaaggccgcgcgcacctggacacggccacccgccgaaagcgttgccctgcccggcacccatcgtatcgtctccccgccacgtccccgtcgacgtccccgccgccgcgcaagcctctccgcaacgctccaacgccacaaaccaacagggaacttgctaccgctagccgaccccctcggtccgttctcttgtcgcaactctcccccggaagcctcgatcggcctgggcgcggccgcggatagactagagagagcgcgccgcggccgcgtgtacctgccgtagcccgccgagataggaaccaactcgaacgcatgtctctattgcatttgcatcggcatcgctatgtatgtactagctacatgacatgcctacgtgtgcgtgctgtaataacctgcccgtttaggtccactaggattcgggaaataacagcacagagagagctcaactgaatatacacacaggacaagagcggccaaggaaaacagaggagcgagcgctttcgtttcgttac

SEQ ID NO: 280 - DNA, 325 bp, Zea mays
catgaaggtgtcgccgatgttgatgaccatggcgcccgggacgggccggacggggcgccactcaccgtccaccagcacctccagcccgcccacgtcgtcctgcaggaggatggtgagcgccgtggggtcgcagtgcgggcccgtgcccagcgtgcgctccggctccgggcacggcgggtagtagttgcaccgcatgatggaccggctgtcctcgaagaactcccggtagtagccgcgcagctccacgcccaggctcagctccagcagctccatgatcgtcagcgacagctccttcatctcctcgcagtacctctggtacacccac

SEQ ID NO: 281 - DNA, 115 bp, Zea mays
ctgccacacatgcatgggacgggacgggggttcatacgtctcccgagtcccgactcgaccgcacgccgacgtgcggtaaatgtaaaccggcgctccttcttactaccttacttac

SEQ ID NO: 282 - DNA, 791 bp, Zea mays
cccattggctcgaaatcctggccgagggtgccgacgaagtagtccacgacgacaggcgacgcggcgccgtcgtggtagccgaacgacagggtctccttccaggggagcttggccgcgaaccggtcggcgtgcgcgctcgtgtacccggacacggtgccggggacgcgccgggcgcgctgcttctcggcgagcggcagccggaagaagtcgctggcgccgtccagcgcggcgcgccccagcgccgcgtccacgccgtgcccgcacacctggaagaacccgtgcgtcgcgcacgccgcggccacctgcgccgcggcgcgccgcagccccgcgcggtcgccattgcgcagcacgcccacgtccaccatcggcacctccagctccgcggccgaggacggccgcgcctcttcctgcggccacaggaatggcgcggggatcttgggctcccggcgcaggtcgaacacggccgcgccggccttgctggccgccgcgtcggccttgtccttgccagcggggaggtcaatgctggggctgggagtgggggcgcggaggaggagcggcggggccgggctggcgtccatggacgtggctgcgcgcttggcgctgctgctgctgctgctaggcacagctggctcttgtcgttcctgcgacaccatgagatgtgcgagctgcaagtatgcagggaagctgtccgggcgggtgggggtatttgtaacaggggaggacagggagtttgcgagcaacgacaaagacgaaggcagggagggaacatttggagggaggcgcggcctcat

SEQ ID NO: 283 - DNA, 398 bp, Zea mays
gtgggacccgacacagtggagcccatggccatggcgcttcgttggaggcagcccatatagagccgagaaggcacaggcctattttaaagtaaagtattatatatttgtaggtacattacaatttttttatagcataaggtgtttgattgtatttctaaaaactgttttttaattattttattttaaaagtatgcaatttttattacgaaactcactttaattcaaaatttttatagcatagctagcttttgactaaaactattgtaacaataatctaatcaattttggtcggtaagaggcccataaaaattagacctggtttacatatattagctaatttttattggtataaaaatagctaattttcaccgactagtgaaggccaataagccattacc

SEQ ID NO: 284 - DNA, 877 bp, Zea mays; identical to SEQ ID NO: 169

SEQ ID NO: 285 - protein, 1227 aa, Unknown
  Description of Unknown: Lachnospiraceae bacterium ND2006 sequence
SKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 286 - protein, 1229 aa, Unknown; identical to SEQ ID NO: 190
  Description of Unknown: Lachnospiraceae bacterium ND2006 sequence

SEQ ID NO: 287 - DNA, 30 bp, Solanum lycopersicum; identical to SEQ ID NO: 171

SEQ ID NO: 288 - DNA, 30 bp, Solanum lycopersicum; identical to SEQ ID NO: 171

SEQ ID NO: 289 - DNA, 33 bp, Solanum tuberosum; identical to SEQ ID NO: 191

SEQ ID NO: 290 - DNA, 30 bp, Solanum tuberosum; identical to SEQ ID NO: 192

SEQ ID NO: 291 - DNA, 200 bp, Zea mays; identical to SEQ ID NO: 172

SEQ ID NO: 292 - DNA, 23 bp, Zea mays
aggacaccgacaacaatgatgcc

SEQ ID NO: 293 - DNA, 23 bp, Zea mays
ggtccactaggattcgggaaata

SEQ ID NO: 294 - DNA, 23 bp, Zea mays
gagccaatggggtaagtaaggta

SEQ ID NO: 295 - DNA, 23 bp, Zea mays
gttaccatgaaggtgtcgccgat

SEQ ID NO: 296 - DNA, 23 bp, Zea mays
gtccaataagaagccggtggtga

SEQ ID NO: 297 - DNA, 23 bp, Zea mays
cacctcggccaaatgccatcagt

SEQ ID NO: 298 - DNA, 23 bp, Zea mays
gttgagctctctctgtgctgtta

SEQ ID NO: 299 - DNA, 23 bp, Zea mays
ctaggattcgggaaataacagca

SEQ ID NO: 300 - DNA, 23 bp, Zea mays
cctcggccaaatgccatcagtgc

SEQ ID NO: 301 - DNA, 23 bp, Zea mays
cgtggtttatctccaccaacaac

SEQ ID NO: 302 - DNA, 19 bp, Artificial Sequence
  Description of Artificial Sequence: Synthetic PCR primer1
aggtgccgatggtggacgt

SEQ ID NO: 303 - DNA, 19 bp, Artificial Sequence
  Description of Artificial Sequence: Synthetic PCR primer2
agcctaccgcctccgcatt

SEQ ID NO: 304 - DNA, 60 bp, Zea mays
gcggccgtccatctttccacctcggccaaagtgcctggcgaacatgtaccagagcaccag

SEQ ID NO: 305 - DNA, 60 bp, Zea mays
ggccgtccatctttccacctcggccaaatgtcagtgcctggcgaacatgtaccagagcac

SEQ ID NO: 306 - DNA, 60 bp, Zea mays
ggccgtccatctttccacctcggccaaatggtgcctggcgaacatgtaccagagcaccag

SEQ ID NO: 307 - DNA, 60 bp, Zea mays
gagtggcgccccgtccggcccgtcccgggcttcttattggacgaaatctccagcgggaag

SEQ ID NO: 308 - DNA, 60 bp, Zea mays
ccggcccgtcccgggcgccatggtcatcaagtgcctggcgaacatgtaccagagcaccag

SEQ ID NO: 309 - DNA, 60 bp, Zea mays
gtccggcccgtcccgggcgccatggtcatcggcttcttattggacgaaatctccagcggg

SEQ ID NO: 310 - DNA, 60 bp, Zea mays
gtccggcccgtcccgggcgccatggtcatcttattggacgaaatctccagcgggaagaca

SEQ ID NO: 311 - DNA, 60 bp, Zea mays
cgtccggcccgtcccgggcgccatggtcatgcttcttattggacgaaatctccagcggga

SEQ ID NO: 312 - DNA, 60 bp, Zea mays
ctgtgtgtatattcagttgagctctctctgcacggctggaccaacagcccccccaaaatc

SEQ ID NO: 313 - DNA, 60 bp, Zea mays
cttggccgctcttgtcctgtgtgtatattcggtgtcctcaaatttctcggacccttcacc

SEQ ID NO: 314 - DNA, 60 bp, Zea mays
tgtatattcagttgagctctctctgtgctggttgtcggtgtcctcaaatttctcggaccc

SEQ ID NO: 315 - DNA, 60 bp, Zea mays
tatattcagttgagctctctctgtgctgtttgttgtcggtgtcctcaaatttctcggacc

SEQ ID NO: 316 - DNA, 60 bp, Zea mays
atattcagttgagctctctctgtgctgttagttgtcggtgtcctcaaatttctcggaccc

SEQ ID NO: 317 - DNA, 60 bp, Zea mays
attcagttgagctctctctgtgctgttattgtcggtgtcctcaaatttctcggacccttc

SEQ ID NO: 318 - DNA, 60 bp, Zea mays
ctcggccaggatttcgagccaatggggtaacttcttattggacgaaatctccagcgggaa

SEQ ID NO: 319 - DNA, 60 bp, Zea mays
cggccaggatttcgagccaatggggtaagtccggcttcttattggacgaaatctccagcg

SEQ ID NO: 320 - DNA, 60 bp, Zea mays
tcggccaggatttcgagccaatggggtaagaaggagcgccggtttacatttaccgcacgt

SEQ ID NO: 321 - DNA, 60 bp, Zea mays
tcggccaggatttcgagccaatggggtaaggtagtaagaaggagcgccggtttacattta

SEQ ID NO: 322 - DNA, 60 bp, Zea mays
ggactacttcgtcggcaccctcggccaggagccggtttacatttaccgcacgtcggcgtg

SEQ ID NO: 323 - DNA, 23 bp, Zea mays
gccgcctctccgacttctccacc

SEQ ID NO: 324 - DNA, 837 bp, Zea mays
atggtggtgccttccacgacgccggtggtgcgccaagaaacgccaccgccgtcccacgacggcataggcataccgacggtggacctgtcggcgccgggcggccgcggcgcgctgtcgcggcaggtggcgcgcgcgtgcgcgcagcacggcttcttccgggccgtgaaccacggcgtggcgccaggccccgccgcacggctggacgccgccgccaggacgttcttcgcgctggcgccgcacaacaagcagcgcgccggcccgcccagcccactcggatacggctgccgcagcatcggcttcaacggcgacgccggggagctcgagtacctgctgctccacgccaacccggccgccgtcgcgcacagggccagatccatcgacactgatgacccctcgcgcttcagcaatgtggtgaacgagtatgtgggagcgatgaggcagctcgcatgtgagatcctggacctgctcggagaggggctagggctcaaggaccccagatccttcagcaggctcatcgctgacacagacagcgactcactcctgcggataaaccactaccctccaccatgcgccattcacaagcttgaccacgacagtcagtgcaggatgaagaacagtttcaggatcgtggcaggcaatggcgcgaaccagtcggcaggtgcacggatcggattcggggagcactcagacccgcagatccttagcttgctccgatcaaacgatgttgacggccttcaggtgcttctgaacagcgacggcagagaggtgtgggttcaggtgccagccgatccatcagcgttctttgtcaatgttggtgatctcctccaggtaaaataa

SEQ ID NO: 325 - protein, 278 aa, Zea mays
MVVPSTTPVVRQETPPPSHDGIGIPTVDLSAPGGRGALSRQVARACAQHGFFRAVNHGVAPGPAARLDAAARTFFALAPHNKQRAGPPSPLGYGCRSIGFNGDAGELEYLLLHANPAAVAHRARSIDTDDPSRFSNVVNEYVGAMRQLACEILDLLGEGLGLKDPRSFSRLIADTDSDSLLRINHYPPPCAIHKLDHDSQCRMKNSFRIVAGNGANQSAGARIGFGEHSDPQILSLLRSNDVDGLQVLLNSDGREVWVQVPADPSAFFVNVGDLLQVK

SEQ ID NO: 326 - DNA, 1089 bp, Zea mays
atgcgttacgtagctgccactccgaccatgccgtcccttgtcgcggagagcgccgccgaaccgcctctggtggacagctacctggagctgctccggcgcggcggcggcggcggcggcattgcggcggcgaccgagggctgcgtgcaggagcgcgagctgcccttgatcgacctgacgtgcctgcagggcagcgcgggcgaggcggcgaggacgacgtgcgcggacgccatggcgagggcggcctcggagtggggctttttccaggtgaccgggcacggcgtgagccgggcgctgttggagcggctgcgggcggagcaggcgcggctgttccggctgccgttcgaaaccaaggccaaggccgggcttctcaacggctcctaccgctggggcgcccccacggccacgtcgctccgccacctctcgtggtcggaggcgttccacgtcccgctcgccagcatctccggcactgcctgcgacttcggagagctcagctccttgagggacgtggtgcaggaggtggcggacgcgatgtcgcgggtggccaagaccgtggcggtggcgctggcggggagccttctgggccacgacgaggcggcggcgttcccggcggggtgcggcgagaccacctgctacctgcggctcaatcggtacccggcgtgcccgttcgcggcgaacaccttcgggctggtgccccacacggacagcgacttcctgacggtgctgtcccaggaccaggtcgggggcctgcagctcatgacggacgccggctgggtggccgtcaagccccgccccgacgcgctcatcgtcaacatcggcgatctgtttcaggcctggagcaacaacctgtacaagagcgtggagcacaaggtggtggccaacgccgcggcggagcgcttctcggcggcctacttcctgtgcccgtcctacgactcgctcgtcggcacgtgcggcgagccgtcaccgtacagagacttcaccttcggggagtacaggaggaaggtgcaggaggacgtcaagaggaccggaagaaagattgggctccccaactttctcaaacaccggccaccccctcaatcacggcccgcctaa

SEQ ID NO: 327 - protein, 362 aa, Zea mays
MRYVAATPTMPSLVAESAAEPPLVDSYLELLRRGGGGGGIAAATEGCVQERELPLIDLTCLQGSAGEAARTTCADAMARAASEWGFFQVTGHGVSRALLERLRAEQARLFRLPFETKAKAGLLNGSYRWGAPTATSLRHLSWSEAFHVPLASISGTACDFGELSSLRDVVQEVADAMSRVAKTVAVALAGSLLGHDEAAAFPAGCGETTCYLRLNRYPACPFAANTFGLVPHTDSDFLTVLSQDQVGGLQLMTDAGWVAVKPRPDALIVNIGDLFQAWSNNLYKSVEHKVVANAAAERFSAAYFLCPSYDSLVGTCGEPSPYRDFTFGEYRRKVQEDVKRTGRKIGLPNFLKHRPPPQSRPA

SEQ ID NO: 328 - DNA, 996 bp, Zea mays
atggtggtgctcgccaaaccgcctgtcgtcgaccagatcccgctcctgcggtccccgggccccagggacagcttctcgggagtgccggtcgtcgacctgtccagccacggcgcggcgcgggcgatcgtcgacgcctgcgagcgcttcgggttcttcaaggtcgtcaaccacggcgtggccgcggccaccatggacagggccgagtccgaggccgtcaggttcttcgcgcaggcgcaggcggacaaggaccgcgcggggccggcgtacccgttcgggtacggcagcaagcggatcgggctcaatggcgacatggggtggctcgagtacctcctcctcgccgtcgacgccgcgtcgctctccgacgcctgccccgtgccctccagcgccgcgttccggagcgcgctgaacgagtacgtcgcggccgtgcggaaggtggcggcgcgtgtgctggaggcgatggcggagggcctgggcattgcggacgcggacgcgctgagctccatggtgagcggcgccgggagcgaccaggtgttccgcgtgaaccactacccgccctgccccgcgctgcagggcctgggctgcagcaccacgggcttcggcgagcacaccgacccgcagatcatctccgtgctccgctccaacggcacctccggcctgcagatcgcgctccgcgacggcgcgcagtgggtctccgtgccctccgaccgcgacgccttcttcgttaacgtcggcgactcgttgcaggtgctgaccaacgggaggttcaggagcgtgaagcaccgggtggtgaccaacagcctcaagtccagagtttccttcatctacttcgcggggccgccgctggggcagcggatcgcgccgctgccgcaggtgctggcggagggagaggagagcctgtacaaggagttcacgtggggcgagtacaagaaggccgcgtacaagacgaggctcggcgacaacaggctggcccagtttgagaagcgtagcaacatctag

SEQ ID NO: 329 - protein, 331 aa, Zea mays
MVVLAKPPVVDQIPLLRSPGPRDSFSGVPVVDLSSHGAARAIVDACERFGFFKVVNHGVAAATMDRAESEAVRFFAQAQADKDRAGPAYPFGYGSKRIGLNGDMGWLEYLLLAVDAASLSDACPVPSSAAFRSALNEYVAAVRKVAARVLEAMAEGLGIADADALSSMVSGAGSDQVFRVNHYPPCPALQGLGCSTTGFGEHTDPQIISVLRSNGTSGLQIALRDGAQWVSVPSDRDAFFVNVGDSLQVLTNGRFRSVKHRVVTNSLKSRVSFIYFAGPPLGQRIAPLPQVLAEGEESLYKEFTWGEYKKAAYKTRLGDNRLAQFEKRSNI

SEQ ID NO: 330 - DNA, 1086 bp, Zea mays
atgccggccttcgcggggggcgcagcggagccgccgctggcagacagctactacgcgctcctccgccgcggcaatgacgatgaaggcgcctacacgacgtcgacagcgccatgggacgacgtctcactgcccgtggcggagtgcgagctcccgatgatcgacgtcgggtgcctgacgaccgccgacgacggcagctccccggaggcggaggcggagcgggcggcgtgcgcggccgccatcgcgcgcgccgccgaggagtggggcttcttccaggtgcgcaaccacggcgtgccgcaggagctcctggaggagatgcgccgggagcaggcgcgcctgttccgcctgccgttcgagaccaaggccacggccggcctgctcaacgactcctaccgctggggcaccccgaccgcgacgtctccgcgccagctgtcctggtccgaggccttccacgtcccgctcgccggcgtctccggctccggcaccacctgcgacttcggcgacctcaccaccctcagggatgtgactcgggaggtggcgggcgcgatgtcaaagctggccggcacgctggcgcgcgtcctggcggaggccctcctgggtcggcggcccgccggcgagcgcttcccggaggggtgcgacgagacgacgtgcttcctgcggctgaaccggtacccggcgtgccccatctccccaggcgccttgggcctggtcccgcacacggacagcgacttcctcaccgtgctctgccaggaccagcaggtcggcggcctgcagctcatgaagggggacagttgggtggccgtcaagccaatccccggcaccctcgtcgtcaacatcggggacctcttccaggcgtggagcaacaacagatacaagagcgtggagcacaaggtgatgacgaacgccaggacggagcgctactccgtcgcctactttctctgcccgtcctacgactcgccgatcggcacgtgcgaggagccttctctctacaggacgttcaccttcggggagtacaggagaaaggtgcaggaagacgtcaagaggaccgggaagaaggtcggcctccctaattttctcgcgcaaacataa

SEQ ID NO: 331 - protein, 361 aa, Zea mays
MPAFAGGAAEPPLADSYYALLRRGNDDEGAYTTSTAPWDDVSLPVAECELPMIDVGCLTTADDGSSPEAEAERAACAAAIARAAEEWGFFQVRNHGVPQELLEEMRREQARLFRLPFETKATAGLLNDSYRWGTPTATSPRQLSWSEAFHVPLAGVSGSGTTCDFGDLTTLRDVTREVAGAMSKLAGTLARVLAEALLGRRPAGERFPEGCDETTCFLRLNRYPACPISPGALGLVPHTDSDFLTVLCQDQQVGGLQLMKGDSWVAVKPIPGTLVVNIGDLFQAWSNNRYKSVEHKVMTNARTERYSVAYFLCPSYDSPIGTCEEPSLYRTFTFGEYRRKVQEDVKRTGKKVGLPNFLAQT

SEQ ID NO: 332 - DNA, 1017 bp, Zea mays
atggcgccggagtctctcccgctcggcattatcccgacggtggacatgtcggcgccgtcggggcgcggcgagctggcgcgccggctggtgcgcgcctgcgcggagcgcggcttcttcaaggccgtcaaccacggcgtgccgccgcgggtgtccgcccggctggacgccgccacgtcggcgttcttcgcgcgccccgctccggtgaagcaggcggccgggccgccggacccgctggggtatggcagccggaacattggtgccaacggcgacgtcggcgagctggagtacctcatcctgcacgcccaacccgcagcagtggcgcgcaaggccatggtcatcgacgcggaggacccttcgcggttcagtgtagcagtgaacgagtacgtggacgcagtgcggcgtctcgcgtgccgggtcctggacctcctcggcgagggcctcggcctcggggacccgacgtccttgagccgcttcgtctcggccgtcgtcgacagcgactccgtcctcaggatcaaccactaccccacgtccagcgcggcggcggatgtgtctgccaagggcatcgggttcggcgagcacaccgacccgcagatcctcagcctgctccgcgccaacgacgtggacggcctgcaggtgctgctgcccgacgcccgcggcggcagcggcggcgaccagtgggtccaggtgccggctgacccgtccgccttcttcatcaacgtcggtgacgcccttcaggccctgacaaacgggcggttggtgagcatccggcacagggtgatggccagcaccacccggccgcggctgtccaccatctacttcgccgcgccgccgctcgacgcccgcatcgcagcgctcccggagacggtggttgccggcgcggcgcggcggtacaggaccttcacatgggcggagtacaagaaggccatgtacgcgctccgcctcagccacaaccgtcttgatctcttccacgcagacgcatcctccggcggcagcggcgataaaaagcatgatatatag

SEQ ID NO: 333 - protein, 338 aa, Zea mays
MAPESLPLGIIPTVDMSAPSGRGELARRLVRACAERGFFKAVNHGVPPRVSARLDAATSAFFARPAPVKQAAGPPDPLGYGSRNIGANGDVGELEYLILHAQPAAVARKAMVIDAEDPSRFSVAVNEYVDAVRRLACRVLDLLGEGLGLGDPTSLSRFVSAVVDSDSVLRINHYPTSSAAADVSAKGIGFGEHTDPQILSLLRANDVDGLQVLLPDARGGSGGDQWVQVPADPSAFFINVGDALQALTNGRLVSIRHRVMASTTRPRLSTIYFAAPPLDARIAALPETVVAGAARRYRTFTWAEYKKAMYALRLSHNRLDLFHADASSGGSGDKKHDI

SEQ ID NO: 334 - DNA, 1002 bp, Zea mays
atggtggtcctcaccaagggcgagctggagcagatcgcgctgccggccgtgcagcgcgcatcgccgccgccgccggccgccgtgccggaggtcgacctggcagccggggacgccgccgccgccgcgcgcgcggtggccaaggcgtgcgaggaccacggcttcttcaaggtgacgggccacggcgtgccgccgcacctcctggcgcgcctcgaggccgccgcggccgcgttcttcgcgctcccgcagcgggagaaggacagggccgccggctgcccgttcggatacgccagcaagcggattggcgccaacggcgatctcggctgggtcgagtacctcctgcttgccgtcaccgccgccggcgcagcggccgcgccggggtctgcgtgcgagggcgcggagccgtcctgtttccgtgctgtgctggacgagtacgtggcggcggtgaggcgcatgacctgcacggtgctgcagctgatggcgcaggggctgggcctcgacgacagggacgtgttcagccggctggtgctggaccgggacagcgactccatgctgagggtgaaccactacccgccagcggcggagacgaggcggctgacggggttcggcgagcacaccgacccgcagatcatctccgtcctccgctccaacgacgcgtccggcctcgagatcacgctgcgggacggcacctgggtgtccgtgccctccgacacggaatccttcttcgtcaatgtcggcgacgcgttgcaggtgctgaccaacgggcggttccggagcgtgcggcaccgggtgatggtgagcagcgcgcggccgcgggtgtcggtgatcttcttcggcggcccgccgccgcgggagcgcctggcgccgctgccgggtctggtggaccgggagggcggccgacgccgctacagggagttcacgtggagggagtacaagaactcggcgtaccggaccaagctggcagacaacaggctctgctccttcgagaccatggcgacgagctag

SEQ ID NO: 335 - protein, 333 aa, Zea mays
MVVLTKGELEQIALPAVQRASPPPPAAVPEVDLAAGDAAAAARAVAKACEDHGFFKVTGHGVPPHLLARLEAAAAAFFALPQREKDRAAGCPFGYASKRIGANGDLGWVEYLLLAVTAAGAAAAPGSACEGAEPSCFRAVLDEYVAAVRRMTCTVLQLMAQGLGLDDRDVFSRLVLDRDSDSMLRVNHYPPAAETRRLTGFGEHTDPQIISVLRSNDASGLEITLRDGTWVSVPSDTESFFVNVGDALQVLTNGRFRSVRHRVMVSSARPRVSVIFFGGPPPRERLAPLPGLVDREGGRRRYREFTWREYKNSAYRTKLADNRLCSFETMATS

SEQ ID NO: 336 - DNA, 1005 bp, Zea mays
atggtcgtcctcgcgaagccgccggctctcgaccaaatctccctgctccgatccccgcagcccggggacgcctcctccttccccggcgtgccggccgtcgacctctccagccccggcgccgccctggccgtggtggacgcgtgcgagcgcttcggcttcttcaaggtcgtcaaccacggcgtgccagcgggcgtcgtggaccggctggaggccgaggccgtcaggttcttcgcgtcgccgcaggcggccaaggacgcgtgcgggtgcggccccgccagcccgctcgggtacgggaacaggcgcatcgggcgcaatggcgacatggggtggctcgagtacctcctcctcgccctcgacggcaacgcctcggtgtccaaggcctcccctgtcccgtcatcctcgctgcgggacgcggtgaaccagtacgtggcctccgtgaggggcctggcgacgtcggtgctggaggcggtggcggaggggctcggcgtggcgccgagggacgcgctgagcggcatggtggcggacgcggcgagcgaccaggtgttccggatcaaccactaccctgcgtgcccgctgctgcagcgcctgccggactcgtgcggcgtcaccggcttcggcgagcacacggacccgcagctggtgtccgtgctgcgctccaacggcacgcccggcctgcagctggcgctccacggcgacgacgggcgctgggtgcccgtgcctcccgaccgcgacgccttcttcgtcatcgtcggcgactcgctgcaggtcctgacgaatgggaggctgaaaagtgtgcggcaccgggtggtggccaacagcctgaagccgcgggtgtccatgatctacttcgcgggaccggcgccggcgcagcggatcgcgccattgccgcagctgctggggcacggcaagcagagcctgtacagggacttcacatggggcgactacaagaaggctgcctaccgctcgcggctcggagacaaccgcctggaccccttccgcatctag

SEQ ID NO: 337 - protein, 334 aa, Zea mays
MVVLAKPPALDQISLLRSPQPGDASSFPGVPAVDLSSPGAALAVVDACERFGFFKVVNHGVPAGVVDRLEAEAVRFFASPQAAKDACGCGPASPLGYGNRRIGRNGDMGWLEYLLLALDGNASVSKASPVPSSSLRDAVNQYVASVRGLATSVLEAVAEGLGVAPRDALSGMVADAASDQVFRINHYPACPLLQRLPDSCGVTGFGEHTDPQLVSVLRSNGTPGLQLALHGDDGRWVPVPPDRDAFFVIVGDSLQVLTNGRLKSVRHRVVANSLKPRVSMIYFAGPAPAQRIAPLPQLLGHGKQSLYRDFTWGDYKKAAYRSRLGDNRLDPFRI

SEQ ID NO: 338 - DNA, 1122 bp, Zea mays
atggtggcgatcacggcgccgagctcgatcgagcagatcccgctgatgcggtgccccagggccaatgcggtgcagcaggcgggcgcggccgtcccgtgcgtggacctgtcggcgccgggcgcgggcgcggcggtggccgacgcgtgccgcagcgtgggcttcttcagggcgacgaaccacggcgtgccggcgcgcgtggccgacgcgctggaggcccgcgcgatggccttcttcgcgctgcccgcgcaggagaagctggacatgtccggcgccgcccggcccctggggtacggcagcaagagcatcggcgccaacggcgacgtcgggtggctggagtacctcctcctgtccgtcagcgccaacaccgtgaagatctcgtcgctgccgccctcgctccgggcggcattggaggagtacacggcggcgttgagggaggtgtgcgggcgggtgctggagctgatagcggaggggctgggcgtggagcggtccctgctgcgcgcgatggtggtggggcgggaaggcagcgacgaggtggtgcgggtgaaccactacccgccctgcccgctgctgccgccggtggactgcggcgtgacggggttcggggagcacacggacccgcagatcatctccgtgctctggtccaaccgcactgcgggcctgcagatcaagctccgggacggcaggtgggtccccgtgccccccacaccggaatccctcttcgtcaacgtcggagactcgctgcaggttctgacgaacgggcggttaaggagcgtgaagcaccgggtggtggcgccggcgccggcgccggatggcgcgcggtcccggctgtccgtgatctacttcggcgggccggcgccgtcgcagcggatcgcgccgctgccgcaggtgatgcgggacggggagcagagcctgtaccgggagttcacgtgggccgagtacaagcgcgccatgtacaagacccgcctcgccgaccaccgcctcgggcccttcgagctgcgcgccagcaccaacggcggcaacaggcccggcgagcccgcggcgggcagcgcggacccggcgcactgcagcggcggcagcgcctgcggcatgccgcagccgcagcaggtggcgcgggtgcactag

SEQ ID NO: 339 - protein, 373 aa, Zea mays
MVAITAPSSIEQIPLMRCPRANAVQQAGAAVPCVDLSAPGAGAAVADACRSVGFFRATNHGVPARVADALEARAMAFFALPAQEKLDMSGAARPLGYGSKSIGANGDVGWLEYLLLSVSANTVKISSLPPSLRAALEEYTAALREVCGRVLELIAEGLGVERSLLRAMVVGREGSDEVVRVNHYPPCPLLPPVDCGVTGFGEHTDPQIISVLWSNRTAGLQIKLRDGRWVPVPPTPESLFVNVGDSLQVLTNGRLRSVKHRVVAPAPAPDGARSRLSVIYFGGPAPSQRIAPLPQVMRDGEQSLYREFTWAEYKRAMYKTRLADHRLGPFELRASTNGGNRPGEPAAGSADPAHCSGGSACGMPQPQQVARVH

SEQ ID NO: 340 - DNA, 1011 bp, Zea mays
atggtggtcctcgccaagggtgagctcgagcagatcgccctcccggctgcagagccgcccccggccgacgtgcggtcggtggacctgtccgccccggcgggccccgcgcgcgaggccgcggcgcgcgcgctggtggcggcgtgcgaggagcacgggttcttccgggtgacgggccacggcgtgccggccagactcgtgcgcgccgcggaggccgcggcggccgggttcttcgcgcggccgcagggcgagaaggaggaggagggccccacgctcgggtacggaagcaagcgcatcggcggcaacggcgacctcggctgggtcgagtacctcctgctcggtggcacacccgccgccgcgccttcctcggcattattgccctgcgccgccgccccgtcgccgtccgcgccggccgggccgttacgggaccttctggacgagtacacggtggcggtgcggcggatggcgtgcgcggtgctggagctgatggcggaggggctgggcatcgccggcggcgccggggacgcggtgctggcgcggctggtggcgcgcgcggacagcgactgcatgctgcgggtgaaccactacccgccgcggccggcgctcaaccccagcctcacggggttcggcgagcacaccgacccgcagatcatctcggtgctccgcgccaacggcacctccggcctggagatcgcgctgcgggacggcgcctgggcctccgtcccgcccgacggggacgccttcttcgtcaacgtcggcgacaccctgcaggtgttgacgaacgggaggttcaggagcgtgaggcacagggtggtggtgaacagcgagaagtcccgggtgtccatggtcttcttcgcggccccgccgcccggcgagaggctgggcccgctgccgcagctcctgggcgacggcggccggagccggtaccgggacttcacctggagcgagttcaagaccagcgggtgcaggaccaggctcgcggaagaccgcctgtcccgcttcgagaagaagtag

SEQ ID NO: 341 - protein, 336 aa, Zea mays
MVVLAKGELEQIALPAAEPPPADVRSVDLSAPAGPAREAAARALVAACEEHGFFRVTGHGVPARLVRAAEAAAAGFFARPQGEKEEEGPTLGYGSKRIGGNGDLGWVEYLLLGGTPAAAPSSALLPCAAAPSPSAPAGPLRDLLDEYTVAVRRMACAVLELMAEGLGIAGGAGDAVLARLVARADSDCMLRVNHYPPRPALNPSLTGFGEHTDPQIISVLRANGTSGLEIALRDGAWASVPPDGDAFFVNVGDTLQVLTNGRFRSVRHRVVVNSEKSRVSMVFFAAPPPGERLGPLPQLLGDGGRSRYRDFTWSEFKTSGCRTRLAEDRLSRFEKK

SEQ ID NO: 342 - DNA, 1017 bp, Zea mays
atggtggtggtgctcgccaacccgcctgtcgtggaccagatcccgctcctgcggtccccgggccccagggacagcttctcgtgcgtgccggtcgtcgacctgtccggccccggcgcggcgcgcgcgatcgtcgacgcctgcgagcgcttcggcttcttcaaggtcgtcaaccacggcgtgcccgcggccaccatggacgtggccgagtccgaggccgtcggcttcttcgcgcaggcgcaggccgacaaggaccgcgcgggcccccgcgcgtcgtacccgttcggctacggcagcaagcggatcggcctcaatggcgacatggggtggctcgagtacctcctcctcgccgtcgactccgcgtcgctctccgacgcctgccccgtcccatccggcgccgcgttccggagcgcgctgaacgagtacgtcgcggccgtgcgggacgtcgcggcgcgcgtgctggaggcgatggcggagggcctgggcatcgcggacgcggccgcgctcagctcgatggtgaccggcgccggcagcgaccaggtgttccgcgtcaaccactacccgccctgccccgcgctgcagggcctgggctgcaccgccaccgccacgggcttcggcgagcacaccgacccgcagatcatctccgtgctccgctccaacggcacgtccggcctgcaggtcgcgctccgcgacgccgcgcaggcgcagcagtgggtgtccgtgccctccgaccgcgacgccttcttcgttaacgtcggcgactcgttgcaggtgctgaccaacgggaggttcgagagcgtgaagcaccgggtggtgaccaacagcctcaagtccagggtttccttcatctacttcgcgggaccggcgctggagcagcggatcgcgccgctggcgcagctgctggcggagggcgaggagagcctgtacagggagttcacgtggggcgagtacaagacggccgcgtacaagacgaggctcggcgacaacaggctggcccagtttcagaggtgtagcatctaa

SEQ ID NO: 343 - protein, 338 aa, Zea mays
MVVVLANPPVVDQIPLLRSPGPRDSFSCVPVVDLSGPGAARAIVDACERFGFFKVVNHGVPAATMDVAESEAVGFFAQAQADKDRAGPRASYPFGYGSKRIGLNGDMGWLEYLLLAVDSASLSDACPVPSGAAFRSALNEYVAAVRDVAARVLEAMAEGLGIADAAALSSMVTGAGSDQVFRVNHYPPCPALQGLGCTATATGFGEHTDPQIISVLRSNGTSGLQVALRDAAQAQQWVSVPSDRDAFFVNVGDSLQVLTNGRFESVKHRVVTNSLKSRVSFIYFAGPALEQRIAPLAQLLAEGEESLYREFTWGEYKTAAYKTRLGDNRLAQFQRCSI

SEQ ID NO: 344 - DNA, 1116 bp, Zea mays
atggtggtgccttccacgacgccggtggtgcgccagcaaacgacgccgccgcagtcatcccacgccggcggcataccgacggtggacctatcggcgcacggcggccgcggcgctctgtcgcggcaggtggtgcgcgcgtgcgcggagcacggcttcttccgggccgtgaaccacggcgtgccgccgggccccgccgcgcggctggacgccgccgccaggacgttcttcgcgctggcgccgcgcgacaagcagcgcgccggcccgcctagcccgctcggctacggctgccgtagcatcggcttcaacggcgacgccggggagctcgagtacctgctgctccacgccaacaacccggccgccgtcgcgcacagggccagggccatcgacgcggaggagccctcgcgattcagtaatgtggtgaacgagtacgtgggagcaatgaggcagcttgcatgtgagatcctggacctgttaggagaggggctagggctcgaggaccccaggtccttcagcaagctcatcaccgacacagacagcgactcactcctgaggatcaaccactaccctacagcatgcaacgctcacaaccttgaccatgacagccagtgcaagatgaagagcagcgtcagaaccaagactactagcaatggcgtgaagccgtcggcaggtggacgggtcggattcggggagcattcagacccgcagattcttagcttgcttcgagcaaatgacgtcgacggccttcaggtgcttctgaacgccgacggcaaggaggtgtgggttcaggtgccggccgatcagtcagcgttctttgtcaatgttggtgacctcctccaggctttaacaaatgggaagctggtaagtgtccggcacagggtaattgcaagctccagcagggcaaggctgtcgacaatctacttcgcagcgccgccactgcatgcgcgaattttggccctcgcagagacgatcacagccaacgcacccagccagtaccggcccttcacctgggccgagtacaagaagacaatgtactcgctccgcctgagccacagccgcctcaacctcttccacatcgaccatgatggccacagcaatgtcggtgaaggagaagaatag

SEQ ID NO: 345 - protein, 371 aa, Zea mays
MVVPSTTPVVRQQTTPPQSSHAGGIPTVDLSAHGGRGALSRQVVRACAEHGFFRAVNHGVPPGPAARLDAAARTFFALAPRDKQRAGPPSPLGYGCRSIGFNGDAGELEYLLLHANNPAAVAHRARAIDAEEPSRFSNVVNEYVGAMRQLACEILDLLGEGLGLEDPRSFSKLITDTDSDSLLRINHYPTACNAHNLDHDSQCKMKSSVRTKTTSNGVKPSAGGRVGFGEHSDPQILSLLRANDVDGLQVLLNADGKEVWVQVPADQSAFFVNVGDLLQALTNGKLVSVRHRVIASSSRARLSTIYFAAPPLHARILALAETITANAPSQYRPFTWAEYKKTMYSLRLSHSRLNLFHIDHDGHSNVGEGEE

SEQ ID NO: 346 - DNA, 1065 bp, Zea mays
atggcaatggaggaagacgacgactacgagccgccgttgatggccacgtacaagcatctgttggacagtcacccgcaccgacaactgggcgccggcgccgcgcaagacgacgaggattgcttcctcctcccggtgatcgacctttccagcctcctgccgccggtgcatcatcgcaagcagtcatcatcagcagcagctgcagagcagtgccgggcgtccatcgtgcgcgccgcctccgagtggggcttcttccaggtgaccaaccacggcgtgccgcaggttctgctggacgagctgcaccaggcgcaggccggcgtcttccgccggcccttccaactcaaggcgcaccagccgctgctggacttctcgccggagagctaccgctggggcacgcccaccgccacgtgcctggagcagctctcgtggtccgaggcctaccacatccccacaacgacgaccacgaccggtaacgacgacaagacccggctagtggtcgaggaggtgtcgacggcgatgtcgaagctggcgcagcggctggcggggatcctcgtcgcggagctgggcgaagacagcgcggcggcggtggtgtcgcggtgcacgcggagcacctgcttcctgcggctgaaccggtacccgccgtgcgcggcggcggccagcggcgtcgtctacgggctgtgcccacactcggacagcgacttcctgaccatactccaccaggacggcgtcggcggcctccagctcgtcaaggacgggcagtgggtagccgtgaagcccagccccggcgcgctcatcgtcaatgtgggcgacctcctgcaggcgtggagcaacgaccggtaccggagcgtcgagcaccgggtgatggccagcgccacgagggagcggttctccgccgccttcttcctgtgccccagctacgacacgctcatccggccgcgctgcggcgccggcggacctcctcctcgctatgagagcttcaccttcggggagtaccggaaccagatcagggaggacgtcaggctcacgggccgaaagctcggcctgcaacgcttccgcaaagcagagtag

SEQ ID NO: 347 - protein, 354 aa, Zea mays
MAMEEDDDYEPPLMATYKHLLDSHPHRQLGAGAAQDDEDCFLLPVIDLSSLLPPVHHRKQSSSAAAAEQCRASIVRAASEWGFFQVTNHGVPQVLLDELHQAQAGVFRRPFQLKAHQPLLDFSPESYRWGTPTATCLEQLSWSEAYHIPTTTTTTGNDDKTRLVVEEVSTAMSKLAQRLAGILVAELGEDSAAAVVSRCTRSTCFLRLNRYPPCAAAASGVVYGLCPHSDSDFLTILHQDGVGGLQLVKDGQWVAVKPSPGALIVNVGDLLQAWSNDRYRSVEHRVMASATRERFSAAFFLCPSYDTLIRPRCGAGGPPPRYESFTFGEYRNQIREDVRLTGRKLGLQRFRKAE

SEQ ID NO: 348 - DNA, 996 bp, Zea mays
atggtggtcctcgccaagggtgagctcgagcagatcgcgctgcctgcggcggcgccgccacgggccgacgtgcggtcggtggacctgtcggccccggcgggcccggcgcgcgaggccgcggcgcgcgcgctggtggcggcgtgcgaggagcacgggttcttccgggtgacgggccacggcgtgccggccgagctcgtgcgcgccgcggaggccgcggcggccgggttcttcgcgcggccgcagggcgagaaggacggggaggcccccacgctcgggtacggcagcaagcgcatcggcggcaacggcgacctcggctgggtcgagtacctcctgctcggcgtcaaccccgccgtgcccgccgcctccgcgtcctcctcgacattgccgttgcggggccttctggacgagtacacggtggcggtgcggcggatggcgtgcgcggtgctggagctgatggcggaggggctgggcatcgccggcgccggggacggggacggggacacggtgctggcgaggctggtggcgcgcgcggacagcgactgcatgctgcgggtgaaccactacccgccgcggccggcgctgaactacccctgcctcacggggttcggcgagcacaccgacccgcagatcatctcggtgctccgcgccaacggcacgtccggcctggaggtcgcgctgcgggacggcgcctgggcctccgtcccgcccgacggggacgccttcttcgtcaacgtcggcgacaccctgcaggtgttgacgaacgggaggttcaggagcgtgaggcacagggtggtggtgaacagcgagaagtcccgggtgtccatgatcttcttcggcgggccgccgcccgacgagaggctggcgccgctgccgcagcttctgggagacgacggcggccggagccggtaccgggacttcacctggagcgagttcaagaccagcgggtgcaggaccaggctcgcggaagaccgcctgtcccgcttcgagaagcagtag

SEQ ID NO: 349 - protein, 331 aa, Zea mays
MVVLAKGELEQIALPAAAPPRADVRSVDLSAPAGPAREAAARALVAACEEHGFFRVTGHGVPAELVRAAEAAAAGFFARPQGEKDGEAPTLGYGSKRIGGNGDLGWVEYLLLGVNPAVPAASASSSTLPLRGLLDEYTVAVRRMACAVLELMAEGLGIAGAGDGDGDTVLARLVARADSDCMLRVNHYPPRPALNYPCLTGFGEHTDPQIISVLRANGTSGLEVALRDGAWASVPPDGDAFFVNVGDTLQVLTNGRFRSVRHRVVVNSEKSRVSMIFFGGPPPDERLAPLPQLLGDDGGRSRYRDFTWSEFKTSGCRTRLAEDRLSRFEKQ

SEQ ID NO: 350 - DNA, 1149 bp, Oryza sativa
atggtggtgccttccgcgacgacgccagcgaggcaggagacggtggtggcggcggcgccgccagctgcggcggcgtccggtgtcgtcggcggcggcggcggcgtgacgatagcgacggtggacatgtcggcggagcgcggcgcggtggcgaggcaggtggcgacggcgtgcgcggcgcacgggttcttccggtgcgtcgggcacggcgtgccggcggcggcgcccgtcgcggcgaggctggacgccgcgacggcggcgttcttcgcgatggcgccggcggagaagcagcgcgccgggccggcgagcccgctcgggtacggctgccggagcatcgggttcaacggcgacgtcggcgagctggagtacctgctcctccacgccaaccccgccgccgtcgcgcaccgggccaggaccatcgacgccatggacccctctcgcttcagtgctattgtgaatgagtacattgaagccatgaagaagctcgcatgtgagatcctggacctgttaggagaggggctaggtctcaaggaccccagatacttcagcaagcttaccacaaacgctgacagtgactgcctcctgaggatcaaccactaccctccatcatgcaacattcacaaacttgaccatgatgaccaatgcaatatcaagagccttgttagcaccaaggctagcaatggtgggaatctgatggcaggtgggcgcattgggttcggcgagcactctgacccgcagatccttagcttgctccgagcaaacgatgtggaagggctacaggtgtttgtgccggaccacgagggcaaggagatgtgggttcaggtgccatcggacccatcggccattttcgtcaatgttggtgatgtcctccaggctctgacaaatgggaggctgataagtatccggcacagggtaattgcaaccgcctgcaggccaaggctgtccacaatatacttcgcatcaccacccctgcatgcacgaatctcggcactcccagagacaatcacagccagcagcccacgccgataccgatcattcacctgggctgagtacaagacgacaatgtactcactccgcctgagccacagccgcctagaactcttcaaaattgacgatgatgacagcgacaatgccagtgagggaaaagcatag

SEQ ID NO: 351 - protein, 382 aa, Oryza sativa
MVVPSATTPARQETVVAAAPPAAAASGVVGGGGGVTIATVDMSAERGAVARQVATACAAHGFFRCVGHGVPAAAPVAARLDAATAAFFAMAPAEKQRAGPASPLGYGCRSIGFNGDVGELEYLLLHANPAAVAHRARTIDAMDPSRFSAIVNEYIEAMKKLACEILDLLGEGLGLKDPRYFSKLTTNADSDCLLRINHYPPSCNIHKLDHDDQCNIKSLVSTKASNGGNLMAGGRIGFGEHSDPQILSLLRANDVEGLQVFVPDHEGKEMWVQVPSDPSAIFVNVGDVLQALTNGRLISIRHRVIATACRPRLSTIYFASPPLHARISALPETITASSPRRYRSFTWAEYKTTMYSLRLSHSRLELFKIDDDDSDNASEGKA

SEQ ID NO: 352 - DNA, 1113 bp, Oryza sativa
atggtggtgccggctgctgctgcgccggaatgcggccgccgggaggcggcggcggcagctgcggccgccgtgttctgtcggcgcggccggggcgtcgtcgtcccgacggtcgacatgtcggcgccggcggggcgcggcgagctgtcgcggcaggtggcgcgggcgtgcgccgggagcggcttcttcagggccgtcaaccacggcgtgccgccgcgggtgtccgcggcgatggacgccgccgcggcggcgttcttcgtgcgggcgggggccgagaagcagctcgccgggccgcccgacccgctgggctacggcagccggagcatcggggcgaacggcgacgtcggcgagctggagtacctgatcctgcacgcgagccccgacgcggtggcgcgcaaggccagcgccatcgacagggaagaccctcgacggttcagccaggtggtaaatgattatgtggaggcagtgaggcagcttgcttgccatgtccttgacctgctaggagagggcctaggcctcagggaccccacatccctgacaaggctcatcacagccactgacaacgactccctcatcaggatcaatcactaccctccatcctgcgccgccgccgccggcgaccacaagtccggcggcggcccggcgccgacggcggccatcgggttcggcgagcacaccgaccctcagatcctcagcgtcctgcgtgccaacgacgccgacggcctgcagctgcttctgccggacgccgccgccgccggcgacagcgtctgggtccccgtgccgcccgacccgtccgcgttcttcgtcaacgtcggtgatctccttcaggctttgacaaacgggaggctggtgagtatccggcacagggtggtggtcggcaccggcaagccgaggctgtcgaccatctacttcgcggcgccgccgctgcacgccaggatctcggctctcccggagacggtggccgccggcgcgccgcgccggtacagggccttcacctgggcggagtacaagaggaccatgtacacgctccgcctcagccacaaccgcctcgacctcttccacgccggcgacggcgacggcgatgccggcgttggggacgatgacgaccatgaatag

SEQ ID NO: 353 - protein, 370 aa, Oryza sativa
MVVPAAAAPECGRREAAAAAAAAVFCRRGRGVVVPTVDMSAPAGRGELSRQVARACAGSGFFRAVNHGVPPRVSAAMDAAAAAFFVRAGAEKQLAGPPDPLGYGSRSIGANGDVGELEYLILHASPDAVARKASAIDREDPRRFSQVVNDYVEAVRQLACHVLDLLGEGLGLRDPTSLTRLITATDNDSLIRINHYPPSCAAAAGDHKSGGGPAPTAAIGFGEHTDPQILSVLRANDADGLQLLLPDAAAAGDSVWVPVPPDPSAFFVNVGDLLQALTNGRLVSIRHRVVVGTGKPRLSTIYFAAPPLHARISALPETVAAGAPRRYRAFTWAEYKRTMYTLRLSHNRLDLFHAGDGDGDAGVGDDDDHE

SEQ ID NO: 354 - DNA, 984 bp, Oryza sativa
atggtggttctcgctggcccgcccgccgtcgatcacatcccgctgctgaggtcgccggaccccggcgacgtcttctccggcgtgccggtcgtcgacctcggcagccccggcgcggcgagggccgtggtggacgcctgcgagcggtacgggttcttcaaggtcgtcaaccacggcgtggccacggacacgatggacaaggccgagtcggaggccgtcaggttcttctcccagacgcagcccgacaaggaccgctccggcccggcctacccgttcgggtacggcagcaagcggatcgggttcaatggcgacatggggtggctcgagtacctcctcctcgccctcgacgacgcgtcgctcgccgacgcctgcaccgtcccgtcctgcgcggtcttccgggccgctctgaacgagtacatctcgggggtgcggaaggtggcggtgcgggtgatggaggcgatgtcggaggggctgggcattgcgcaggcggacgcgctgagcgcgctggtgacggcggaagggagcgaccaggtgttccgcgtgaaccactacccgccgtgccgcgcgctgcaggggctcggctgcagcgtcaccggcttcggcgagcacaccgacccgcagctcgtctccgtgctccgctcaaacggcacgtccggcctgcagatcgcgctccgcgacggccagtgggtgtccgtgccctccgaccgcgactccttcttcgtcaacgtcggcgactcgttgcaggttctgaccaatgggaggttcaagagcgtgaagcacagggtggtggccaacagcctaaagtctagggtttccttcatctactttggagggccaccgttagcacagaggattgcaccattgccacagctgctgggggagggagagcagagcctgtacaaggagttcacatgggatgagtacaagaaggctgcctacaaatcaaggcttggagacaacaggctggcccagtttgagaagaagtag

SEQ ID NO: 355 - protein, 327 aa, Oryza sativa
MVVLAGPPAVDHIPLLRSPDPGDVFSGVPVVDLGSPGAARAVVDACERYGFFKVVNHGVATDTMDKAESEAVRFFSQTQPDKDRSGPAYPFGYGSKRIGFNGDMGWLEYLLLALDDASLADACTVPSCAVFRAALNEYISGVRKVAVRVMEAMSEGLGIAQADALSALVTAEGSDQVFRVNHYPPCRALQGLGCSVTGFGEHTDPQLVSVLRSNGTSGLQIALRDGQWVSVPSDRDSFFVNVGDSLQVLTNGRFKSVKHRVVANSLKSRVSFIYFGGPPLAQRIAPLPQLLGEGEQSLYKEFTWDEYKKAAYKSRLGDNRLAQFEKK

SEQ ID NO: 356 - DNA, 729 bp, Oryza sativa
atggtggtgctcgcgaagccggcggcgctggagcagatctcgctggtgaggtcgccgtcggtggaggataacttcggcgccgggttgccggtggtggacctggccgcggacggcgcggcgggcgaggtggtgcgggcgtgcgagaggtttgggttcttcaaggtggtgagccatggcgtcggggagggcgtggtgggtaggctggaggcggaggccgtccggttcttcgcgtcgccgcaggcggcgaaggacgcgcacggccccgcgtcgccgttcgggtacgggagcaagcgcatcggccgcaatggcgacatggggtggctcgagtacctcctccaggtcgccctccaccacgacgccgacgccggcgaccaccagtgggtcaccgtccctcccgaccccgcctccttcctcgtcatcgtcggcgactcgctgcaggtgatgacgaacgggaggatgaggagcgtccggcacagggtggtggccaacaagctcaagtcgagggtgtcaatgatctacttcggagggccgccattggagcagaggatcgcgccgctgcggcagctgctggtggccggcgtcggcaacggcgaggaggaggagcagagccggtacgaggagttcacgtggggggagtacaagaaggctgcctacctctcccgcctcagcgacaaccgcctggcccccttccaccggcagccaccacctgtcgctaacccactcgcctaa

SEQ ID NO: 357 - protein, 242 aa, Oryza sativa
MVVLAKPAALEQISLVRSPSVEDNFGAGLPVVDLAADGAAGEVVRACERFGFFKVVSHGVGEGVVGRLEAEAVRFFASPQAAKDAHGPASPFGYGSKRIGRNGDMGWLEYLLQVALHHDADAGDHQWVTVPPDPASFLVIVGDSLQVMTNGRMRSVRHRVVANKLKSRVSMIYFGGPPLEQRIAPLRQLLVAGVGNGEEEEQSRYEEFTWGEYKKAAYLSRLSDNRLAPFHRQPPPVANPLA

SEQ ID NO: 358 - DNA, 1026 bp, Oryza sativa
atggaggagcacgactacgactccaactcgaacccgccgttgatgagcacgtacaagcacctgttcgtggagcagcaccgcctggacatggacatgggcgccatcgacgtcgacgagtgcgagctccctgtgatcgacctcgcggggctcatggaggcggagcaggtgtgccgcgcagacatggtgcgtgcggcgtcggaatggggcttcttccaggtgaccaaccacggcgtgccgcaggcgctgctgcgcgagctgcacgacgcacaggtggccgtgttccggcggcccttccaggagaaggtgaccgagaggctgctcggcttctcgccggagagctaccggtggggaacgccgacggccaagtgcctggagcagctgtcgtggtcggaggcctatcacatcccaatgacgacgcccaggcccagcacgagcatcagggccagggcggtgatcgaggaggtgtcgagggcgatgtacgagctggcgcagaagctggcagagatcctgatgagagggctgccgggcgccggcgagggcgagacgatggtgacgacgcgggaggagacgtgcttcctgcggctgaaccggtacccaccgtgcgccatggccatggggggcttcgggctgtgcccgcacacggacagcgacttgctcaccatcgtgcaccagcagcaggacaccgtcggcggcctccagctgctcaagggcggcaggtgggtggccgtgaagcccagccccagcaccctcatcgtcaacgtcggcgacctcctgcaggcgtggagcaacgatgtgtacaagagcgtggagcacagggtgatggccaacgccacgctggagcgcttctccatggccttcttcctctgcccctcctaccacacgctcatcatcccaagcagcagccatgtccacgacgacgatgcccattaccggagcttcaccttcggcgagtacaggaagcagatcatggaggacgtcaggagcacaggccgcaagattggactgcaccgctttcgaacccgatag

SEQ ID NO: 359 - protein, 341 aa, Oryza sativa
MEEHDYDSNSNPPLMSTYKHLFVEQHRLDMDMGAIDVDECELPVIDLAGLMEAEQVCRADMVRAASEWGFFQVTNHGVPQALLRELHDAQVAVFRRPFQEKVTERLLGFSPESYRWGTPTAKCLEQLSWSEAYHIPMTTPRPSTSIRARAVIEEVSRAMYELAQKLAEILMRGLPGAGEGETMVTTREETCFLRLNRYPPCAMAMGGFGLCPHTDSDLLTIVHQQQDTVGGLQLLKGGRWVAVKPSPSTLIVNVGDLLQAWSNDVYKSVEHRVMANATLERFSMAFFLCPSYHTLIIPSSSHVHDDDAHYRSFTFGEYRKQIMEDVRSTGRKIGLHRFRTR

SEQ ID NO: 360 - DNA, 1077 bp, Oryza sativa
atgccggccttcgccgacatcgccatcgacccgcctctggccgacagctaccgcgcgctggcgctgctccgccgcgaccgcgacggtggcattgcgccgccggctgtgcagatggtcggctcgggcggcgccgtgctggagcgcgacctgccgatggtggacctggagcggctgacgaggggcggcgcgggggagaggaaggcgtgcgcgggcgccatggcgagggcggcgtcggagtgggggttcttccagctgaccaaccacggcgtgggccgggagctgatggaggagatgaggcgggagcaggcaaggctgttccgtctgccgttcgaaaccaaggagaaggccggcctgctcaacggctcgtaccggtggggcaaccccaccgccacgtcgctccgccacctctcgtggtcggaggcgttccacgtcccgctcgccagcatctccggggcggattgcgactttggagacctcacctccttaaggggcgtgatgcaggaggtggccgaagcgatgtcgcgggtggcgaacacggtggcagcggcgctggcggaggagctgaccgggcgcggaggcggcggggcatcggcggcgccgtggttccctgcggggtgcgacgagacgacgtgcttcctgcggctcaaccggtacccggcgtgccctttcgcggcggacacgttcgggctggtgccgcacacggacagcgacttcctcaccgtcctgtgccaggaccaggtcgggggcctgcacctgatgaaggactcccggtgggtggccgtcaggccacgccccgacgccctcgtcgtcaacatcggcgatctgtttcaggcgtggagcaacaacaggtacaagagcgtggagcataaagtggtggccaacgccaagacggaccggctatcggtggcctacttcctgtgcccgtcctacgactcgcttgtcgggacatgcggcgagccatcgccatacagggccttcaccttcggggagtacaggaagaaggtgcaggaagacgtcaggacaaccgggaaaaagattggcctcccaaactttttcaagcattcttcagtacaataa

SEQ ID NO: 361 - protein, 358 aa, Oryza sativa
MPAFADIAIDPPLADSYRALALLRRDRDGGIAPPAVQMVGSGGAVLERDLPMVDLERLTRGGAGERKACAGAMARAASEWGFFQLTNHGVGRELMEEMRREQARLFRLPFETKEKAGLLNGSYRWGNPTATSLRHLSWSEAFHVPLASISGADCDFGDLTSLRGVMQEVAEAMSRVANTVAAALAEELTGRGGGGASAAPWFPAGCDETTCFLRLNRYPACPFAADTFGLVPHTDSDFLTVLCQDQVGGLHLMKDSRWVAVRPRPDALVVNIGDLFQAWSNNRYKSVEHKVVANAKTDRLSVAYFLCPSYDSLVGTCGEPSPYRAFTFGEYRKKVQEDVRTTGKKIGLPNFFKHSSVQ

SEQ ID NO: 362 - DNA, 1008 bp, Oryza sativa
atggtggtgcttgccaagggcgagctcgagcagatagccctgccggcggcgcacccgccgccagccgacgtgcgcgcgatcgacctgtccgccacgggtcccgcccgcgcggcggaggcgcgcgcgctggtggcggcgtgcgaggagcaggggttcttccgggtgacgggccacggcgtgccgccggggctggtgcgcgccgcggaggccgccgcggcgcggttcttcgcgctgccgcagcccgacaaggaggccgccgcaggggcgccgctcgggtacgccagcaagcggatcggcagcgccggcgacctcggctggatcgagtacctgctactctgcctcgcccccgccgccgccgccgcggcattgccgtgcgccgcgacgtcgcccacgcctccttgccccttacgggagcttctacgcgagtacagcgcggcggtgcggcgggtggcgtgcggcgtgctggagctgatggcggaggggctcggcgtcgggccggcggacgcgctggcgcggctggtggcgcgcgaggacagcgactccatcctcagggtgaaccactacccgccgcgccccgatcagctgggcggcggcggcgggccgaacctgacggggttcggcgagcacaccgacccgcagatcatctccgtgctccgctccaacggcgcccccgggctggagatctccctccgtgacggcgcctgggcgtccgtgccgcacgacggcgacggcgactcctttttcgtcaacgtcggcgacaccctccaggtgctaacgaacgggaggttcaggagcgtgaagcacagggtggtggtgaacagcgagaagtcgagggtgtccatggtcttcttcggcggcccgccgcccggcgagaggctggcgccgctgccggcgttattaggggacggcggccggagccggtacagggagttcacctggaaggagtacaagggcagcggctgcaagggccggctcgccgacgacaggctctgcagatttgagaactag

SEQ ID NO: 363 - protein, 335 aa, Oryza sativa
MVVLAKGELEQIALPAAHPPPADVRAIDLSATGPARAAEARALVAACEEQGFFRVTGHGVPPGLVRAAEAAAARFFALPQPDKEAAAGAPLGYASKRIGSAGDLGWIEYLLLCLAPAAAAAALPCAATSPTPPCPLRELLREYSAAVRRVACGVLELMAEGLGVGPADALARLVAREDSDSILRVNHYPPRPDQLGGGGGPNLTGFGEHTDPQIISVLRSNGAPGLEISLRDGAWASVPHDGDGDSFFVNVGDTLQVLTNGRFRSVKHRVVVNSEKSRVSMVFFGGPPPGERLAPLPALLGDGGRSRYREFTWKEYKGSGCKGRLADDRLCRFEN

SEQ ID NO: 364 - DNA, 1062 bp, Oryza sativa
atggtggcgatcacggcgccgagctccatcgagcacatcccgctggtgaggtgccccaagggcgccaatgccgggccgcaagctgtcatcccgtgcatcgacctgtcggcaccgggcgcggcggcggcggtggccgacgcgtgccgcaccctggggttcttcaaggcgaccaaccacggcgtccccgcggggctcgccgacgcgttggagtcgagcgccatggcgttcttcgcgctcccgcaccaggagaagctcgacatgtccggccccgcccggcccctcggctacggcagcaagagcatcgggtcgaacggcgacgtggggtggctggagtacctcctcctctcggccggcgccgcctcgtccggcggcgcggcgctgccggcggcgctgagggcggcggtggaggcgtacacgggggcggtgaggggggtggggtgcagggtgatggagctgatggcggaggggctggggctgggggcgtcggaggaggggaggtgcgtgctgcggcggatggtggtggggtgcgagggcagcgacgagatgctgcgggtgaaccactacccgccgtgcctcctcccgccgggccgcgaccgggacgagtgcggcgtgacgggcttcggggagcacacggacccacagatcatctccgtgctcaggtccaactgcaccgcgggcctccagatcctcctccgcggagactactcctcccctgcccgctgggtccccgtgccccccgaccccgattccttcttcgtcaacgtcggcgactccctccaagtgttgacgaatgggaggttcaggagcgtgaagcacagggtgttggcgccggagggggaggagtcgaggctgtcggtgatctacttcggcgggccagcggcgtcgcagcggatcgcgccgctggagcaggtgatgcgggagggggagcagagcctgtacagggagttcacctggggggagtacaagaaggccgcctacaagacgcgcctcggcgacaaccgcctcggcccctacgagctgcagcacgccgctgccaacgatgaggccgcgacgaagaaataa

SEQ ID NO: 365 - protein, 353 aa, Oryza sativa
MVAITAPSSIEHIPLVRCPKGANAGPQAVIPCIDLSAPGAAAAVADACRTLGFFKATNHGVPAGLADALESSAMAFFALPHQEKLDMSGPARPLGYGSKSIGSNGDVGWLEYLLLSAGAASSGGAALPAALRAAVEAYTGAVRGVGCRVMELMAEGLGLGASEEGRCVLRRMVVGCEGSDEMLRVNHYPPCLLPPGRDRDECGVTGFGEHTDPQIISVLRSNCTAGLQILLRGDYSSPARWVPVPPDPDSFFVNVGDSLQVLTNGRFRSVKHRVLAPEGEESRLSVIYFGGPAASQRIAPLEQVMREGEQSLYREFTWGEYKKAAYKTRLGDNRLGPYELQHAAANDEAATKK

SEQ ID NO: 366 - DNA, 900 bp, Oryza sativa
atgccggccatcgcggattgcgcggccgacccgccgctggcggacagctactacacgctgctccgcctcggcggggacgacgacgacgacgcgtgcacgaaggtgaccacgacgccgcagcccgtgtcggagtgcgagctcccgatgatcgacgtcggttgcctgacggcgccgaccggcgccgccgccgccgccgccgtggggcagcagcatcaagccgaggagagggcggcctgcgcggcggccatcgcggcggcggccgcggagtgggggttcttccaggtggtgaaccacggcgtcgcgcaggagctcctggaggcgatgcgccgggagcaggcgcggctgttccgcctcccgttcgaggccaagtccagcgccggcctcctcaacgactcctaccgctggggcaccccgaccgccacctcgctccgccagctctcctggtcggaggccttccacctcccgctcgccggcatctccggcaaatcctgcaactacggcgacctcacctccctcagggacgtgacgcgggaggtggcggacgcgatgtcgaggctggccagggcgctggcgcgcgtgctggcggagagcctcctgggccacgccgccggcgagcgattcccggaggggtgcgacgacgcgacgtgcttcctccggctgaaccgctacccgccgtgccccttcccaccggacgacgccttcggcctggtcccgcacaccgacagcgacttcctcaccgtgctctgccaggaccacgtcggcggcctgcagctcatgaagggctcccgctgggtcgccgtcaagcccatccccggcgccctcatcgtcaacatcggagacctttttcaggtacacccattaactccaacgttgtataaacatctcaacacaaatccctaa

SEQ ID NO: 367 - protein, 299 aa, Oryza sativa
MPAIADCAADPPLADSYYTLLRLGGDDDDDACTKVTTTPQPVSECELPMIDVGCLTAPTGAAAAAAVGQQHQAEERAACAAAIAAAAAEWGFFQVVNHGVAQELLEAMRREQARLFRLPFEAKSSAGLLNDSYRWGTPTATSLRQLSWSEAFHLPLAGISGKSCNYGDLTSLRDVTREVADAMSRLARALARVLAESLLGHAAGERFPEGCDDATCFLRLNRYPPCPFPPDDAFGLVPHTDSDFLTVLCQDHVGGLQLMKGSRWVAVKPIPGALIVNIGDLFQVHPLTPTLYKHLNTNP

SEQ ID NO: 368 - DNA, 1080 bp, Oryza sativa
ctagctactagcattctagttgtcgctcagtcatggtggttttggcgaagggggagttggagcagatcgccctgccggcggcggtgcagaagggcggcgccgccgctggccgacgtgccggaggtggacctgggcggcggcgcctgcagggcggacgcggcgcgcgcggtggtggcggcgtgcgagggacacgggttcttcaaggtgacgggccacggcgtgccggcggggctcctggcgcgcgtggaggccgcggcggcggcgttcttcgcgatggcgcagccggagaaggaggcggcggcggcggcggccgccgccgccgtgccggggagcccgttcgggtacgggagcaagaggatcggctgcaacggggacctcgggtgggtcgagtacctcctgctcggcgtcgccgccgccgccgccgcgccattgcccgcgcacggcgaggcgtcgccgtcgccgtcgtacggctcgttccgcgatatcttaaatgagtacgttgtggcggtgagagcgatgatgtgggaggtgctaaagttaatggcggaagggctaggcctgaaggagaaagatgcgttggttaggctggtctcacacgaggagagtgactccgtgctgagggtgaaccactacccaccacaccctgagttgaagcagcaaggccatggtaggttaaccgggtttggagagcacaccgaccctcagatcatctcggtgctccgatccaacgacacctctggccttgagatctctttgcgtgatggtagctgggcttctgtgcctccggatcgaaagtcgttcttcgttaatgttggagatgtcttacaggttctaacgaacgggagatttcgaagcgtgaggcaccgggtgatggtgagtagcccgcggccacgggtgtcagtcatcttcttcgccgggccgccgccacgggagcgactagcgccgctgccatggctggtggcggaggatggcgggcgccgccggtacagggagttcacctggcgggagtacaaggcttcagcctacaggaccaagctggctgagaacaggctatgtcactttgaaactgaagctgactga

SEQ ID NO: 369 - protein, 359 aa, Oryza sativa
LATSILVVAQSWWFWRRGSWSRSPCRRRCRRAAPPLADVPEVDLGGGACRADAARAVVAACEGHGFFKVTGHGVPAGLLARVEAAAAAFFAMAQPEKEAAAAAAAAAVPGSPFGYGSKRIGCNGDLGWVEYLLLGVAAAAAAPLPAHGEASPSPSYGSFRDILNEYVVAVRAMMWEVLKLMAEGLGLKEKDALVRLVSHEESDSVLRVNHYPPHPELKQQGHGRLTGFGEHTDPQIISVLRSNDTSGLEISLRDGSWASVPPDRKSFFVNVGDVLQVLTNGRFRSVRHRVMVSSPRPRVSVIFFAGPPPRERLAPLPWLVAEDGGRRRYREFTWREYKASAYRTKLAENRLCHFETEAD

SEQ ID NO: 370 - DNA, 1128 bp, Hordeum vulgare
atggtggtgccctccacgacgccggcgcggcaagagacggcgaccctgcttcttccacaggcacagccgtcccccggcggcggcgccataccgacggttgacatgtcggcgccccgcggccgcggcgcgctgtcccggcaggtggcgcgtgcgtgcgcggagcagggcttcttccgtgccgtcaaccacggcgtgcctccggcggggcccccggcacggctggacgcggccacctcggcgttcttcgcgctcgcggcacacgacaagcagcgcgccggcccgccgagcccgctcggctacggctgccgcagcatcgggttcaacggcgacgtgggcgagctggagtacctcctcctccatgccaaccccgccgccgtcgcgcacagggccagctccatcgacaccaacgatccctcacgcttcagttctgttgtgaatgagtatgtggaagcagtgaagcagcttgcatgtgacatcctggacctgttaggagaagggctagggctagaggaccccaggctcttcagcaagctcgtcacagaagctgacagtgactccctcctgaggatcaaccactaccctccatcatgcaccgttcacaagcttgaccatgatgaccaatgcaagctcaaggggatcgccaggaccaaggcagggaatggtgcgaacccgggggcgggtggccggatcgggttcggtgagcactccgacccacagctacttagcttgctccgagcaaacgatgttgatggcttgcaggtgcttctgccggacgtcaatggcaaggatgcgtggattcaggtgccagcagactcgtcggcctatttcgtcaatgttggtgatctccttcaggctctgacaaatgggaggttagtcagcatccggcacagagtaattgcaagtgcctgcaggccaaggctgtccaccatctacttcgcagccccaccactgcatgcacgaatctcggcgctcccagagatggtcacagccagctcaccacgccggtaccggtcattcacctgggctgagtacaagacggcaatgtactcgctccgactaagccacagccgcctggacctcttccatgttgatgatgacgaaagcggcaatggcagcaaaggaaaataa

SEQ ID NO: 371 - protein, 375 aa, Hordeum vulgare
MVVPSTTPARQETATLLLPQAQPSPGGGAIPTVDMSAPRGRGALSRQVARACAEQGFFRAVNHGVPPAGPPARLDAATSAFFALAAHDKQRAGPPSPLGYGCRSIGFNGDVGELEYLLLHANPAAVAHRASSIDTNDPSRFSSVVNEYVEAVKQLACDILDLLGEGLGLEDPRLFSKLVTEADSDSLLRINHYPPSCTVHKLDHDDQCKLKGIARTKAGNGANPGAGGRIGFGEHSDPQLLSLLRANDVDGLQVLLPDVNGKDAWIQVPADSSAYFVNVGDLLQALTNGRLVSIRHRVIASACRPRLSTIYFAAPPLHARISALPEMVTASSPRRYRSFTWAEYKTAMYSLRLSHSRLDLFHVDDDESGNGSKGK

SEQ ID NO: 372 - DNA, 1047 bp, Hordeum vulgare
atggtggcgtccactgcggcaccggcgtcgtcctctgcagcagcaccggcgtgccgcggcatggcgcctgccggcattcccacgatcgacatgtcggcgccggcggggcgcgcggagctgtcccgccagatggtggaggcgttcgccgagcgcggcttcttcaaggcggtcaaccacggcgtgccgccgcgggcgtccgcccggctggacgcggccagcgcggccttcttcgcgcggccggcggaggagaagcaggaggccgggccgccggacccgctgggctacggcagccggagcatcggctcccacggcgacgtcggcgagctggagtacctgatcctccacacggaccccgaggtggtggcgcgcaaggccagggccatcgacagggacgacccttcacgattcagtgaggcggtgaacgagtacgtgcaggcagtgaggcaccttgcctgccggatccttgacctgctgggcgaaggcctgggcctccgggaccctgcgtccttgagcaggctcatcacgaccacggacagcgactccctcgtccggatcaaccattacccagcttcggccgccggcgatggcggcgtgaaaaccgcaggctccgtcgggttcggggagcacactgacccacagatcctcagcgtcctccgtgccaacgacgtagatggcctgcaggtgctcctgccggacggccgcggcgaggacgcctgggtgagggttccggctgaccctgccgccttcttcatcaatgtcggtgaccttcttcaggctttgacgaacgggaagctggtgagcatccggcatagggtgatggccagcagcagcaagccaaggctgtcagctatctacttcgccgcgccggcgttgcacgagcgcatctcggcgctcccggagacggtgaccgccgccgcgccgcgccggtaccggccattcacctgggcggagtacaaaaaaacgatgtacacgcttcgtctgagccacaaccgcctcaacctcttcgcagtcgtcggtgattccggtgaagacaagcctcagatatag

SEQ ID NO: 373 - protein, 348 aa, Hordeum vulgare
MVASTAAPASSSAAAPACRGMAPAGIPTIDMSAPAGRAELSRQMVEAFAERGFFKAVNHGVPPRASARLDAASAAFFARPAEEKQEAGPPDPLGYGSRSIGSHGDVGELEYLILHTDPEVVARKARAIDRDDPSRFSEAVNEYVQAVRHLACRILDLLGEGLGLRDPASLSRLITTTDSDSLVRINHYPASAAGDGGVKTAGSVGFGEHTDPQILSVLRANDVDGLQVLLPDGRGEDAWVRVPADPAAFFINVGDLLQALTNGKLVSIRHRVMASSSKPRLSAIYFAAPALHERISALPETVTAAAPRRYRPFTWAEYKKTMYTLRLSHNRLNLFAVVGDSGEDKPQI

SEQ ID NO: 374 - DNA, 981 bp, Hordeum vulgare
atggtggttctcgccggcacgcctgccgtcgatcacatcccgctcctcaggtcccccgaccccggggacaacttctccggcatgccggtcgtggacctgtccagacctggcgcgccgcgggcaatcgccgacgcgtgcgagcgcttcggcttcttcaagctcgtcaaccacggggtggccctggacgcgatggaccggctcgagtcggaggccgtgaggttcttctcgctgccgcaggccgacaaggaccgctccggcccggcctacccgttcggctacggcagcaagcgcatcgggctcaatggcgacatggggtggctcgagtacctcctcctcgccgtcgactccgcctcgctccccgccgcctccgccgtcccgtcctgcgcgctcttccgggcggcgctgaacgagtacatcgcggcggtgaggaaggtggcggtgcgggtgatggaggcgatggcggaggggctgggcattgcgcaggcggacgcgctgagcgcgatggtggcggtggagggcagcgaccaggtgttcagggtgaaccactacccgccgtgccacgcgctgcaggggctcggctgcagcgccaccggcttcggcgagcacaccgacccgcagctcatctccgtgctgcgctccaacggcacgtccggcctgcagatcgcgctccagagcggccactgggtgtccgtgccctccgaccgcgacgccttcttcgtcaacgtcggcgactccttgcaggtgctgaccaacgggaggttcaagagcgtgaagcacagggtggtggccaacagcctaaagtctagggtttccatgatctactttggagggccagcattgacacagaggattgcaccattgccgcagctgctgagagagggagagcagagcctgtacaaggacttcacatggggcgagtacaagaaggctgcctacaactccaggctcggggacaacaggctggctcacttccacaggtag

SEQ ID NO: 375 - protein, 326 aa, Hordeum vulgare
MVVLAGTPAVDHIPLLRSPDPGDNFSGMPVVDLSRPGAPRAIADACERFGFFKLVNHGVALDAMDRLESEAVRFFSLPQADKDRSGPAYPFGYGSKRIGLNGDMGWLEYLLLAVDSASLPAASAVPSCALFRAALNEYIAAVRKVAVRVMEAMAEGLGIAQADALSAMVAVEGSDQVFRVNHYPPCHALQGLGCSATGFGEHTDPQLISVLRSNGTSGLQIALQSGHWVSVPSDRDAFFVNVGDSLQVLTNGRFKSVKHRVVANSLKSRVSMIYFGGPALTQRIAPLPQLLREGEQSLYKDFTWGEYKKAAYNSRLGDNRLAHFHR

SEQ ID NO: 376 - DNA, 1029 bp, Hordeum vulgare
atggtggtcctcgcgaagccggcggcgctggagcagatcgcgctgatgaggactcctgagccgtgggagagcttctcgggcgtcccggccgtggacctgtccagccccggcgccgcggcggacgtggtgcgcgcgtgcgagcggttcgggttcttcagcgtcgtgaaccacggcgtgccggcgggcgtggtggaccggctggaggcggaggccgtccggttcttcgcgtctacgcaggcggagaaggacgcgtcgggccccgccgacccgttcggatacgggagcaagcgcatcgggcgcaatggtgacatggggtgggtcgagtacctgctcctcgccatcgaccgcgacaccctctccaaggcctccccggcgccgtcgtccgcgctgagggaagcgatcaacgcgtacgtgtccgccatgcgcgggctggcgaggacggtgctggagatggtggcggaggggctgggcgtgtcgccgcggggcgcgctggcggacatggtgacgggcgaggccagcgaccaggtgttccgggtgaaccactacccgccctgcccgctgctgcaggggctgccgcccaactgcagcgtgaccgggttcggcgagcacacggacccgcagctggtgtccatcctgcactccaacggcacggccgggcttcaggtcgcgctccacgacgggcgctgggtgtccgtcccgcccaaccgcgacgccttcttcgtcaacgtcggcgactccctccaggttctgacgaatgggaggctgaggagtgtgcggcaccgggtggtggccggcaacgggctcaagtcccgcgtgtcgatgatctacttcgccgggccaccgctggcgcagaggattgcaccgctgcagcagctgctggcggggacgcagagcttgcccctctacagggacttcacatggggagaatacaagaaggcggcctaccgctctcgcctcggcgacaaccgcctggcccccttcgagacgccacttgtcgccatgccacacgccgcccaccaccggtcctag

SEQ ID NO: 377 - protein, 342 aa, Hordeum vulgare
MVVLAKPAALEQIALMRTPEPWESFSGVPAVDLSSPGAAADVVRACERFGFFSVVNHGVPAGVVDRLEAEAVRFFASTQAEKDASGPADPFGYGSKRIGRNGDMGWVEYLLLAIDRDTLSKASPAPSSALREAINAYVSAMRGLARTVLEMVAEGLGVSPRGALADMVTGEASDQVFRVNHYPPCPLLQGLPPNCSVTGFGEHTDPQLVSILHSNGTAGLQVALHDGRWVSVPPNRDAFFVNVGDSLQVLTNGRLRSVRHRVVAGNGLKSRVSMIYFAGPPLAQRIAPLQQLLAGTQSLPLYRDFTWGEYKKAAYRSRLGDNRLAPFETPLVAMPHAAHHRS

SEQ ID NO: 378 - DNA, 1026 bp, Hordeum vulgare
atggtggtccttgccaagggcgagctggagcagatagccctgccggcggcgcagccgccgctggcccacgtgcgggcgatcgacctgtccgccgccccggggcccggccgcgacgccgcggcgcgcgcgctggtgtccgcgtgcgaggagcagggcttcttcaaggtgaccggccacggggtgccgctggagctcgtgcgcgccgtggaggcggccgcggcggagttcttcgcgctgccgcaggccgagaaggaggccgccgccggccggccgctcgggtacggcagcaagcggatcggcgtctccggcgacctcgggtggatcgagtacctcctgctgggcgtcacccccgccggcgcgctgcccgccgcctccttcgcgtcctggacattgccgtgcgcgggcgccgccgtggcgtcgtcgtccgagcacccctgccccttacgggatcttctggaggagtacgcggcggcggtgcggcggatggcgtgcggcgtgctggagctgatggcggaggggctcgggatcgggccggcggacgcgctgtcccggctggtgtcggacggtgagagcgacaacatgctccgggtgaaccactacccgcctcggccggagatgcagggctgcctcctgacggggttcggcgagcacacggacccgcagatcatctccgtgctccgctccaacggcacgtccgggctggagatctgcgcgcgcgacggcgaatggacctccgtgccgcccgaccccgacgccttcttcgtcaacgtcgccgatgccctgcaggtgctgacgaacgggaggttcagcagcgtgaagcacagggtggtggtgagcagcgagaggccgagggtgtccatgatcttcttcggcggcccgccgatgggcgagaggctggcgccgctgcggcagctgcttggggatggcggccggagcaagtacagggagttcacctggaaggagtacaagagcagcacccacaagggcaggctcgcgaccgaccgcctctgcagcttcgagaactag

SEQ ID NO: 379 - protein, 341 aa, Hordeum vulgare
MVVLAKGELEQIALPAAQPPLAHVRAIDLSAAPGPGRDAAARALVSACEEQGFFKVTGHGVPLELVRAVEAAAAEFFALPQAEKEAAAGRPLGYGSKRIGVSGDLGWIEYLLLGVTPAGALPAASFASWTLPCAGAAVASSSEHPCPLRDLLEEYAAAVRRMACGVLELMAEGLGIGPADALSRLVSDGESDNMLRVNHYPPRPEMQGCLLTGFGEHTDPQIISVLRSNGTSGLEICARDGEWTSVPPDPDAFFVNVADALQVLTNGRFSSVKHRVVVSSERPRVSMIFFGGPPMGERLAPLRQLLGDGGRSKYREFTWKEYKSSTHKGRLATDRLCSFEN

SEQ ID NO: 380 - DNA, 1050 bp, Hordeum vulgare
atggtggttcttgccaagggcgagctggagcagatcgcgctcccggccgtgcacaagacagcaccgccactggccgacttgccggaggtcgacctttccgtggcaagaagcggctctgagggacgggcggccgccgcacgcgcggtggcggcggcgtgcgaggagcatgggttcttcaaggtgacgggccacggcgtgccagcagagctcctggcgcgcgtcgagaacgccgctgccgcgttcttcgcgctctcgcagcgggacaaggaggcggcgatgtcggccgcgacgccgggcagtccgttcggctacgcgagcaagcggataggcaacaacggcgacctcgggtgggtcgagtatctcctgctcggtgtcaccgccgcgggcgccgaggccggcgcgccattgtccgtgcccgaagaggtggtgccgtcagcgtcgctctgctctttccgggaccttctgaacgagtacacggtggccgtgaggaggatgacctgccagttgctggagctgatggcggagggcctgggcatggaagacagggacgcgttcacgaggctggtcctgcacaaggagagcgactcgatgctgcgagtgaaccactacccgccgcgccccgagctgaagcagcaccacggtggcagggtcaccgggttcggcgagcacaccgacccccagatcatctccgtgctccgctccaacgccacctccggcctagagatcgccctgcgcgacggcgactgggtctccgtgccgccggaccagacctccttcttcgtcaatgttggcgacgccttgcaggtactcacgaacgggaggttccggagcgtgagacatcgagtgatggtgaacaacatccaaccgcgggtgtcggtgatcttcttcggcggcccgccgccgcgggagacgctcgcgccgctaccacaactcgtcggggaaggcgggcgcagccgctacaaggaattcacatggtgtgagtacaaagcctcggcgtatggaaccaagctggcggcgaacaggctctgccacttcgagaccaccaactag

SEQ ID NO: 381 - protein, 349 aa, Hordeum vulgare
MVVLAKGELEQIALPAVHKTAPPLADLPEVDLSVARSGSEGRAAAARAVAAACEEHGFFKVTGHGVPAELLARVENAAAAFFALSQRDKEAAMSAATPGSPFGYASKRIGNNGDLGWVEYLLLGVTAAGAEAGAPLSVPEEVVPSASLCSFRDLLNEYTVAVRRMTCQLLELMAEGLGMEDRDAFTRLVLHKESDSMLRVNHYPPRPELKQHHGGRVTGFGEHTDPQIISVLRSNATSGLEIALRDGDWVSVPPDQTSFFVNVGDALQVLTNGRFRSVRHRVMVNNIQPRVSVIFFGGPPPRETLAPLPQLVGEGGRSRYKEFTWCEYKASAYGTKLAANRLCHFETTN

SEQ ID NO: 382 - DNA, 1173 bp, Hordeum vulgare
atgaccacaactgcaaacgttcccctgctccttacttctcttctgctcctgctctgcttcacttacatatcggtgctctgcgagatcgtcctgctggccatggtgggggtcacggtgcctatctccgtggacacgatcccgctggtgaaatgtgcacatgccgcggcggccgcggtgccgagcgtcgacctgtcggcgccggacgcgggggcggccgtggcggccgcgtgccgccgcgtgggcttcttcagggcgaccaaccacggcgtgccggcggccctgaccgacgcgctggaggcccgcgccgaggccttcttcgcgctgccgcacgaggacaagctggaggcgtcggcgcggcccttcggctacggcagcaagagcatcggctgcaacggcgacgtgggctggctcgagtacatccttctctccgtcgggtccggctccgtcgccgccgcctgcctgccgccgtcgctccgggcggcgctggaggagtacacggacgcggtccgcgaggtgggagcgcgggtgctggagctgatggcggacggtctcggcgtggcggaggagcaccgcggcgtgctgcggcggatggcggaggcggacggagccgacgagatggtgcgcgtaaaccactacccgccgtgcccctgccccctggcagctgggcagcgcggcgtgacggggttcggggagcacacggacccgcagatcatctccgtgctcaggtccaaccgcaccgggggcctccagatcgcgctcccggacggccactgggtacccgtggcccccgaccccgattccctcttcgtcaatgtcggggactccctccaggtgctgacgaacgggcggttccggagcgtgaagcaccgggtggtggcgccggcggaggggcagcagccgcggctgtcggtgatctacttcggcgggccggcgccgacgcagcggatcgcgccgctgccggagctgatgcgggaaggggagcagagcctgtacagggacttcacctgggccgagtacaagaaggccgcctacaagtcccgcctcggcgaccaccgcctaggcccattcgagctccccgccgccgaaaaacccaccagctccgacaagcactgcggcagcaacgccgtccagctgccggcgccggcgccccttcacgtggcacgagtgcactag

SEQ ID NO: 383 - protein, 390 aa, Hordeum vulgare
MTTTANVPLLLTSLLLLLCFTYISVLCEIVLLAMVGVTVPISVDTIPLVKCAHAAAAAVPSVDLSAPDAGAAVAAACRRVGFFRATNHGVPAALTDALEARAEAFFALPHEDKLEASARPFGYGSKSIGCNGDVGWLEYILLSVGSGSVAAACLPPSLRAALEEYTDAVREVGARVLELMADGLGVAEEHRGVLRRMAEADGADEMVRVNHYPPCPCPLAAGQRGVTGFGEHTDPQIISVLRSNRTGGLQIALPDGHWVPVAPDPDSLFVNVGDSLQVLTNGRFRSVKHRVVAPAEGQQPRLSVIYFGGPAPTQRIAPLPELMREGEQSLYRDFTWAEYKKAAYKSRLGDHRLGPFELPAAEKPTSSDKHCGSNAVQLPAPAPLHVARVH

SEQ ID NO: 384 - DNA, 1095 bp, Hordeum vulgare
atggtggcgatcacggtgcccatctcggtggacacgatcccgctgctgaaatgcgtgaatgcggcgacggcggcggtccccagcgtcgacctgtcggcgccgggcgctgcggcggccgtggcggacgcgtgccgcgccgtgggcttcttcagggcgaccaaccacggcgtgccggccgccctcacggacgcgctggaggaacgcgccgcggccttcttcgcgctgccgcacaaggacaagatggacgcgtcggcgcggcccttcggctacggcagcaagaacatcggctgcaacggcgacgtgggctggctcgagtacatcctcctatccgtccgttccggctccgtcgccgccgcctccctgccgccgtcgctccgggctgcgcttgaggagtacacggacgcggtgcgcgaggtgggagcgcgggtgctggagctcatggcggacgggctcggcgtcgcggaggagcaccgcggcgtgctgcggcggatggtggcgccggacgatgccggaggggctgacgagatggtgcgcgtgaaccactacccgccgtgtccctcgtccctggcggtggggcagcgcggcgttacggggttcggggagcatacggacccgcagatcatctccgtgctccggtccaaccgcaccgccgggctccagatcatgctcccagacggccgctgggtccccgtagcccccgacactgattccctcttcgtcaacgtcggggactccctccaggtgctgacgaacgggcggttccggagcgtgaagcaccgggtggtggcgccggcggaggggcagcagccgcggctgtcggtgatctacttcggcgggccggcgccgacgcagcggatcgcgccgctgccggagctgatgcgggaaggggagcagagcctgtacagggacttcacctgggccgagtacaagaaggccgcctacaagtcccgcctcggcgaccaccgcctaggcccattcgagctccccgccgcagccaccgcccaagaatccactaccaaggcggaccaccactgcagcagcaacgctgccgtccaggcgccggcggcggcgcctcacgtcgcacgagtgcattag

SEQ ID NO: 385 - protein, 364 aa, Hordeum vulgare
MVAITVPISVDTIPLLKCVNAATAAVPSVDLSAPGAAAAVADACRAVGFFRATNHGVPAALTDALEERAAAFFALPHKDKMDASARPFGYGSKNIGCNGDVGWLEYILLSVRSGSVAAASLPPSLRAALEEYTDAVREVGARVLELMADGLGVAEEHRGVLRRMVAPDDAGGADEMVRVNHYPPCPSSLAVGQRGVTGFGEHTDPQIISVLRSNRTAGLQIMLPDGRWVPVAPDTDSLFVNVGDSLQVLTNGRFRSVKHRVVAPAEGQQPRLSVIYFGGPAPTQRIAPLPELMREGEQSLYRDFTWAEYKKAAYKSRLGDHRLGPFELPAAATAQESTTKADHHCSSNAAVQAPAAAPHVARVH

SEQ ID NO: 386 - DNA, 1146 bp, Sorghum bicolor
atggtggtgccttccacgacgccggtggtggtgcgccaagaaacgccgccgccgccgctgccgctgccgccgtcccacgacggcataataggcataccgacggtggacatgtcggcgccgggcggccgcggcgcgctgtcgcggcaggtggcgcgcgcgtgcgcggagcacggcttcttccgcgccgtgaaccacggcgtggcggtggcgccagcggcaggccccgccgcgcggctggacgccgccgccaggacgttcttcgcgctgccgccgcacgacaagcagcgcgccggcccgcccagcccgctcggctacggctgccgcaccatcggcttcaacggcgacgccggcgagctcgagtacctgctgctccacgccaaccccgccgccgtcgcgcacagggccaggtccatcgacactgacgacccctcgcgcttcagtaatgtggtgaacgagtatgtgggagcaatgaggcagcttgcatgtgagatcctggacctgttaggagaggggctagggctcaaggaccccagatccttcagcaagctcatcactgacacagacagcgactcactcctgaggatcaaccactaccctccagcatgcaccattcagaagcttgaccatgacaaccaatgcaagatgaagagcagtttcagaatcaagactggcaatggtgtgaaccagtcagcaggtgcacggatcggattcggggagcattcagacccgcagattcttagcttgctccgatcaaacgatgttgacggccttcaggtgcttctgaactgcgacggcagggaggtgtgggttcaggtgccatccgatccatcagcattctttgtcaatgttggtgatctcctccaggctttgacaaatgggaaggtgataagtgtccggcacagggtaattgcaaactcctgcagggcaaggctgtccacaatctacttcgctgcgccgccactgcatgcacgaattttggccctcccagagacaatcacagccaactcaccccgccagtaccggcccttcacctgggccgagtacaagaagacaatgtactccctccgcctgagccacagccgcctcaacctcttccacatcgaccatgatgaccacagcaatgtcggcaaaggagaacaagaatag

SEQ ID NO: 387 - protein, 381 aa, Sorghum bicolor
MVVPSTTPVVVRQETPPPPLPLPPSHDGIIGIPTVDMSAPGGRGALSRQVARACAEHGFFRAVNHGVAVAPAAGPAARLDAAARTFFALPPHDKQRAGPPSPLGYGCRTIGFNGDAGELEYLLLHANPAAVAHRARSIDTDDPSRFSNVVNEYVGAMRQLACEILDLLGEGLGLKDPRSFSKLITDTDSDSLLRINHYPPACTIQKLDHDNQCKMKSSFRIKTGNGVNQSAGARIGFGEHSDPQILSLLRSNDVDGLQVLLNCDGREVWVQVPSDPSAFFVNVGDLLQALTNGKVISVRHRVIANSCRARLSTIYFAAPPLHARILALPETITANSPRQYRPFTWAEYKKTMYSLRLSHSRLNLFHIDHDDHSNVGKGEQE

SEQ ID NO: 388 - DNA, 777 bp, Sorghum bicolor
atggtagtgccatcggcggcaggccgggagatggcgccggaatcgctcccgctcggcattatcccgacggtggacatgtcggcgccgtgcggcgagctggcgcgccggctggtgcgcgcgtgcgcggagcgcggcttcttcaaggccgtcaaccacggcgtgccgccgcgggtgtccgcgcggatggacgccgccgcgtcggcgttcttcgcgcgccccgggcaggcgaagcaggcggcggggccgcccgacccgctcgggtatggcagccggaacattggtgccaacggcgacgtcggcgagctggagtacctcatcctgcacgccgatcccggcgcagtggcgcgcaaggccaaggtcatcgacaaggacgatccttcgcggttcagtgtcgcagtgaacgagtacgtgggcgcagtgcggcacctcgcgtgccgggtcctggacctcctcggcgagggcctcggcctcagggacccgacgtccttgagccgcctcatctccgccgtcgacagcgactccctcctcaggatcaaccactaccctacgtccaggtccagcgcggcggacatctccaccaagggcatcgggttcggcgagcacaccgacccgcagatcctcagcctgctccgcgccaacgacgtcgacggcctgcaggtgctgctgcccgacggccacggcggcggcgacgagcagtgggtccaggtgccggctgacccgtccgccttcttcatcaacgtcggtgatctccttcagaataatatgatactgttctga

SEQ ID NO: 389 - protein, 258 aa, Sorghum bicolor
MVVPSAAGREMAPESLPLGIIPTVDMSAPCGELARRLVRACAERGFFKAVNHGVPPRVSARMDAAASAFFARPGQAKQAAGPPDPLGYGSRNIGANGDVGELEYLILHADPGAVARKAKVIDKDDPSRFSVAVNEYVGAVRHLACRVLDLLGEGLGLRDPTSLSRLISAVDSDSLLRINHYPTSRSSAADISTKGIGFGEHTDPQILSLLRANDVDGLQVLLPDGHGGGDEQWVQVPADPSAFFINVGDLLQNNMILF

SEQ ID NO: 390 - DNA, 1005 bp, Sorghum bicolor
atggtcgtcctcgcgaagccaccgccggcgctcgaccaaatctccctgcttcgatgcccgcagcccggggacgcggcgtccttcttcggcgtgccggccgtcgacctgtccagccccggcgcggctctggccgtggtggacgcgtgcgagcggttcggcttcttcaaggtggtgaaccacggcgtgccaacgggcgtcgtggatcggctggaggccgaggccgtcaggttcttcgcgtcgccgcaggcggacaaggacgcgtgcggccccgccaacccgctcgggtacgggaacaagcgcatcggccgcaatggcgacatggggtggctcgagtacctcctcctcgccctcgacggcgcctcctcggtgtccaaggcctcccctgtcccgtcatcctcgctgcgggacgcggtaaaccagtacgtcgccgccgtgcggggactggcgacgtcggtgctggaggcggtggcggaggggctgggcgtggcgccgagggacgcgctgagcggcatggtgacggacgcggcgagcgaccaggtgttccggatcaaccactacccggcgtgcccgctgctgcagcgcctgccggactcgtgcggcgtcaccggcttcggcgagcacacggacccgcagctggtgtccgtgctgcgctccaacggcacggccggcctgcaggtcgcgctccacgacgacggggggcggtgggtgcccgtgccgcccgaccgcgacgccttcttcgtcatcgtcggcgactcgctgcaggtcctgacgaatgggaggctgaaaagtgtgcggcaccgggtggtggccaacagcctgaagccgcgggtgtccatgatctacttcgcgggaccggcgccggcgcagcggatcgcgccattgccgcaggtgctggggcacggcgagcagagcttgtacagggacttcacatggggcgactacaagaaggctgcctaccgatcgcgcctcggagacaaccgcctggaccccttccgcatccagtga

SEQ ID NO: 391 - protein, 334 aa, Sorghum bicolor
MVVLAKPPPALDQISLLRCPQPGDAASFFGVPAVDLSSPGAALAVVDACERFGFFKVVNHGVPTGVVDRLEAEAVRFFASPQADKDACGPANPLGYGNKRIGRNGDMGWLEYLLLALDGASSVSKASPVPSSSLRDAVNQYVAAVRGLATSVLEAVAEGLGVAPRDALSGMVTDAASDQVFRINHYPACPLLQRLPDSCGVTGFGEHTDPQLVSVLRSNGTAGLQVALHDDGGRWVPVPPDRDAFFVIVGDSLQVLTNGRLKSVRHRVVANSLKPRVSMIYFAGPAPAQRIAPLPQVLGHGEQSLYRDFTWGDYKKAAYRSRLGDNRLDPFRIQ

SEQ ID NO: 392 - DNA, 1101 bp, Sorghum bicolor
atggtggcgatcacggcgccgagctcgatcgagcagatcccgctggtgcagtgtcccagggccaatgcgagcgcggccatcccgtgcgtggacctgtcggcgccgggcgcggccgcggcggtggccgacgcgtgccgcggcgtgggcttcttcagggcgaccaaccacggcgtgccggcgcgcgtggtcgaggcgctggaggcccgcgcgatggcgttcttcgcgctgcccgcccaggagaagctggacatgtccggcgccgctcgccccatggggtacggcagcaagcgcatcggctccaacggcgacgtcgggtggctcgagtacctcctcctctccgtcagcgccaacaccgtcaagatctcctccctgccgccctcgctccgagcggcattggaggagtacacggcggcggtgagggaggtgtgcgggcgggtgctggagctcatagcggaggggctgggcgtggacaggtccctgctgcgtgcgatggtggtggggcgggaaggcagcgacgagctggtgcgggtgaaccactacccgccctgcccgctgctgccgccggtggactgcggcgtgacggggttcggggagcacacggacccgcagatcatctccgtgctcaggtccaacagcacggctggcctgcagatcaagctccgggacggcaggtgggtccccgtgccccccgccccggaatccttcttcgtcaacgtcggagacgcgctgcaggtcctgacgaacgggcggttcaagagcgtgaagcaccgggtggtggcgccggaaggggcgcagtcacggctgtcggtgatctacttcggcgggccggcgccgtcgcagcggatcgcgccgctgccggaggtgatgcgggacggggagcagagcctgtaccgggagttcacctgggccgagtacaagaccgccatgtacaagacccgcctcgccgaccaccgcctcggccccttcgagctgcgcgccaccaacaccaacagctgcgtgccgccgccgccgccgcccagcgtcgacccgtactgcaacggcagcggcatctgcatgccgcagccgccgccgcagcagcagcaggtggcagaggtgcactag

SEQ ID NO: 393 - protein, 366 aa, Sorghum bicolor
MVAITAPSSIEQIPLVQCPRANASAAIPCVDLSAPGAAAAVADACRGVGFFRATNHGVPARVVEALEARAMAFFALPAQEKLDMSGAARPMGYGSKRIGSNGDVGWLEYLLLSVSANTVKISSLPPSLRAALEEYTAAVREVCGRVLELIAEGLGVDRSLLRAMVVGREGSDELVRVNHYPPCPLLPPVDCGVTGFGEHTDPQIISVLRSNSTAGLQIKLRDGRWVPVPPAPESFFVNVGDALQVLTNGRFKSVKHRVVAPEGAQSRLSVIYFGGPAPSQRIAPLPEVMRDGEQSLYREFTWAEYKTAMYKTRLADHRLGPFELRATNTNSCVPPPPPPSVDPYCNGSGICMPQPPPQQQQVAEVH

SEQ ID NO: 394 - DNA, 1062 bp, Sorghum bicolor
atggtggtcctcgccaagggtgagctcgagcagatcgccctgccggcggcggagccgccgccagccgacgtgcggtcggtggacctgtcggccccggcgggccccgcgcgcgaggccgcagcgcgcgcgctggtggcggcgtgcgaggagcacgggttcttccgggtgacgggccacggcgtgccgccggagctcgtgcgcgccgcggaggccgcggcggccgggttcttcgcgcagccgcaggacgagaaggacgaggaggctcccacgctcgggtacggcagcaagcgcatcggcggcaacggcgacctcgggtgggtcgagtacctcctgctcggcgtcacccccgccggcgccgccgtgccggctgcctccgcgtcctcctcgacattgccgtgcgctgccgccgccgccgccgccaccgcatcgtcgccgtccgcgccggccgggtcggccgggctgttacgggaccttctggacgagtacacggtggcggtgcggcggatggcgtgcgcggtgctggagctgatggcggaggggctgggcatcgccggcggcgccggggacggggacgtgctggcgcggctggtgacgcgcgcggacagcgactgcatgctgcgggtgaaccactacccgccgcggccggcgttgaacccctgcagcctgacggggttcggcgagcacacggacccgcagatcatctcggtgctccgcgccaacggcacctccggcctggagatcgcgctgcgggacggcgcctgggcctccgtcccgcccgacggcgacggcttcttcgtcaacgtcggcgacaccctgcaggtgttgacgaacgggaggttcaggagcgtgaggcacagggtggtggtgaacagcgagaagtcccgggtgtccatggtcttcttcggcgggccgccgccgggcgagaggctggcgccgctgccgcagctgctgggcgacggcggccggagccggtaccgggacttcacctggagcgagttcaagaacagcgggtgcaggaccaggctcgcggaagaccggctgtcccgcttcgagaacaagtag

SEQ ID NO: 395 - protein, 353 aa, Sorghum bicolor
MVVLAKGELEQIALPAAEPPPADVRSVDLSAPAGPAREAAARALVAACEEHGFFRVTGHGVPPELVRAAEAAAAGFFAQPQDEKDEEAPTLGYGSKRIGGNGDLGWVEYLLLGVTPAGAAVPAASASSSTLPCAAAAAAATASSPSAPAGSAGLLRDLLDEYTVAVRRMACAVLELMAEGLGIAGGAGDGDVLARLVTRADSDCMLRVNHYPPRPALNPCSLTGFGEHTDPQIISVLRANGTSGLEIALRDGAWASVPPDGDGFFVNVGDTLQVLTNGRFRSVRHRVVVNSEKSRVSMVFFGGPPPGERLAPLPQLLGDGGRSRYRDFTWSEFKNSGCRTRLAEDRLSRFENK

SEQ ID NO: 396 - DNA, 993 bp, Sorghum bicolor
atggtggtgctcgccaacccgcctgtcgtcgaccagatcccgctgctgcggtccccggggcccagggacaccttctcgggcgtgccggtcgtcgacctgtccagccccgccgcggcgcgcgcgatcgtcgacgcctgcgagcgcttcggcttcttcaaggtcgtcaaccacggcgtgcccgcggccaccatgggcagggccgagtccgaggccgtcaggttcttcgcgcaggcgcaggccgacaaggaccgcgccggcccggcgtacccgttcggctacggcagcaagcggatcgggctcaatggcgacatggggtggctcgagtacctcctcctcgccgtcgactccgcgtcgctctccgacgcctgccccgtcccctccaccgccgccttccggagcgcgctgaacgagtacgtcgcggcggtgcggaaggtggcggtgcgcgtgctggaggcgatggcggaaggcctgggcattgcggacgcggccgcgctgagctcgatggtgaccggcgccggcggcgaccaggtgttccgcgtgaaccactacccgccgtgcccggcgctgcagggcctgggctgcagcgccacgggcttcggcgagcacaccgacccgcagctcatctccgtgctccgctccaacggcacgtccggcctgcagatcgcgctccgcgacggcgcgcagtgggtgtccgtgccctccgaccgcgacgccttcttcgttaacgtcggcgactcgttgcaggtgctgacgaacgggaggttcaagagcgtgaagcaccgggtggtgaccaacagcctcaagtctagggtttccttcatctacttcgcgggaccggcgctggagcagcggatcgtgccgctgccggagctgctggcggagggcgaggagagcctgtacaaggagttcacgtggggcgagtacaagaaggccgcgtacaagacgaggctcggggacaacaggctggcccagtttgagaagcgtagcatctag

SEQ ID NO: 397 - protein, 330 aa, Sorghum bicolor
MVVLANPPVVDQIPLLRSPGPRDTFSGVPVVDLSSPAAARAIVDACERFGFFKVVNHGVPAATMGRAESEAVRFFAQAQADKDRAGPAYPFGYGSKRIGLNGDMGWLEYLLLAVDSASLSDACPVPSTAAFRSALNEYVAAVRKVAVRVLEAMAEGLGIADAAALSSMVTGAGGDQVFRVNHYPPCPALQGLGCSATGFGEHTDPQLISVLRSNGTSGLQIALRDGAQWVSVPSDRDAFFVNVGDSLQVLTNGRFKSVKHRVVTNSLKSRVSFIYFAGPALEQRIVPLPELLAEGEESLYKEFTWGEYKKAAYKTRLGDNRLAQFEKRSI

SEQ ID NO: 398 - DNA, 1167 bp, Sorghum bicolor
atggcgagctgcatgcaggagtggccggagcccgtcgtccgcgtgcaggcgctcgccgagagcggcctgtccgtcatcccgcgctgctacgtcaagccgccgtgcgaccgccccgtcgtcgtggccccggcggcgccaacggcagtcaaggagacgaattcgaataaggcggccgaggcctcggacatcagcattccggtcgtcgacctcggcgagctgctgctgcaggcgaaggacgccggcgccggcggccttgtcgggaacgtcgtcaccgaggccgtcgcgtccgcgtgccgcgagtggggattctttcaggtggtcaaccacggggtgcgccccgagctgatgcgcgcggcgcgggagtcctggcgcggcttcttccgccgcccgctcgcggagaagcagcgctacgccaactcgccgcgcacgtacgagggctacggcagccgcctcggcgtccagaagggcgccgtcctcgactggggcgactacttcttcctccacctcgcgccggaggcggctaagagcgcggcaaacttctggccggccaaccccagcaactgcaaggaggtgtcggaggagtacgggcgcgaggtggtgcgggtgtgcgagctgctgatgcgggtgctgtccgtgagcctagggctggacgaggcgcacttccagcgggcgttcggcggggcggactgcggcgcgacgctgcgcgccaactactacccgcggtgcccgcagccggacctgacgctgggcctctccgcgcactcggacccgggcgccctcaccgtcctcctcgccgacgagaacgtccgcggcctgcaggtccgccgcggcgacgacggcgagtgggtcaccgtgcagcccgtccgcgacgccttcatcgtcaacgtcggcgaccaagtccagatactgagcaactccgtgtacaagagcgtggagcaccgggtggtcgtgaacgccgaggaggagcgcatatccctcgcgctcttctacaaccccaagggcgacgtccccatctccccggcgccagggctggtcaccgccgggaacctgccggcgctctacccgccgatgaccttcgacgagtacaggctctacatcaggaataagggcgccaggggcaaggcgcagatcgaggctctcaagggccaggcatcgccagaaaaataa

SEQ ID NO: 399 - protein, 388 aa, Sorghum bicolor
MASCMQEWPEPVVRVQALAESGLSVIPRCYVKPPCDRPVVVAPAAPTAVKETNSNKAAEASDISIPVVDLGELLLQAKDAGAGGLVGNVVTEAVASACREWGFFQVVNHGVRPELMRAARESWRGFFRRPLAEKQRYANSPRTYEGYGSRLGVQKGAVLDWGDYFFLHLAPEAAKSAANFWPANPSNCKEVSEEYGREVVRVCELLMRVLSVSLGLDEAHFQRAFGGADCGATLRANYYPRCPQPDLTLGLSAHSDPGALTVLLADENVRGLQVRRGDDGEWVTVQPVRDAFIVNVGDQVQILSNSVYKSVEHRVVVNAEEERISLALFYNPKGDVPISPAPGLVTAGNLPALYPPMTFDEYRLYIRNKGARGKAQIEALKGQASPEK

SEQ ID NO: 400 - DNA, 1041 bp, Sorghum bicolor
atggtagtgccatcggcggcaggccgggagatggcgccggaatcgctcccgctcggcattatcccgacggtggacatgtcggcgccgtgcggcgagctggcgcgccggctggtgcgcgcgtgcgcggagcgcggcttcttcaaggccgtcaaccacggcgtgccgccgcgggtgtccgcgcggatggacgccgccgcgtcggcgttcttcgcgcgccccgggcaggcgaagcaggcggcggggccgcccgacccgctcgggtatggcagccggaacattggtgccaacggcgacgtcggcgagctggagtacctcatcctgcacgccgatcccggcgcagtggcgcgcaaggccaaggtcatcgacaaggacgatccttcgcggttcagtgtcgcagtgaacgagtacgtgggcgcagtgcggcacctcgcgtgccgggtcctggacctcctcggcgagggcctcggcctcagggacccgacgtccttgagccgcctcatctccgccgtcgacagcgactccctcctcaggatcaaccactaccctacgtccaggtccagcgcggcggacatctccaccaagggcatcgggttcggcgagcacaccgacccgcagatcctcagcctgctccgcgccaacgacgtcgacggcctgcaggtgctgctgcccgacggccacggcggcggcgacgagcagtgggtccaggtgccggctgacccgtccgccttcttcatcaacgtcggtgatctccttcaggccctgacaaacgggcggttggtgagcatccggcacagggtgatggccagcaccaccaggccgcggctgtccaccatctacttcgccgcgccgccgctcgacgcccgtgtcgcggcgctgccggagacggtgactgccggcgcgccgcggcggtacaggaccttcacgtgggcggagtacaagaaggccatgtacgcgctccgcctcagccacaaccgtcttgatctcttccacgcaacctctggcagcagccgcgatgtcatcgatgatgatcacgaacaataa

SEQ ID NO: 401 - protein, 346 aa, Sorghum bicolor
MVVPSAAGREMAPESLPLGIIPTVDMSAPCGELARRLVRACAERGFFKAVNHGVPPRVSARMDAAASAFFARPGQAKQAAGPPDPLGYGSRNIGANGDVGELEYLILHADPGAVARKAKVIDKDDPSRFSVAVNEYVGAVRHLACRVLDLLGEGLGLRDPTSLSRLISAVDSDSLLRINHYPTSRSSAADISTKGIGFGEHTDPQILSLLRANDVDGLQVLLPDGHGGGDEQWVQVPADPSAFFINVGDLLQALTNGRLVSIRHRVMASTTRPRLSTIYFAAPPLDARVAALPETVTAGAPRRYRTFTWAEYKKAMYALRLSHNRLDLFHATSGSSRDVIDDDHEQ

SEQ ID NO: 402 - DNA, 1149 bp, Sorghum bicolor
atggcggcggcgggcgtggtcgtgttcgacgcggaggtgctgagccgggaggagcggatcccggcgcagttcgtgtggccggccgaggatcgggcgccgtcggcgggcggctgcggcgtggaggagatcgccatccccgtggtggacctcggcgagttcctccgccacggggatcgggagctgccgcgcggcgtggcggaggcgtgcgagcgccacggcttcttccaggtggtgaaccacggcgtccccgccgcgctgctcgccgacgcctaccgctgcctcgacgccttctacgcgcgcccgctcgccgacaagcagcgcgcgcagcggcgccccggggagtcccacggctacgccagcagcttcacgggccgcttccgctcctgcctgccctggaaggagacgctctccttcaactgccccgccggcaccggcggcgacacccagagcgccgccgccgtcgtcgactacttcgtcgacgtcctcggcgaggactaccgccacatgggagaggtgtaccaggagtactccgacgagatggcgcggctagcgatggacgtgacggaggtgctggcggcggcgctgggcctgcgccgcggcgcgctgcgcgggttcttcgacggcggcgactccatcatgcggctgaaccactacccggcgtgccggcagccgcaactgacgctggggacggggccgcaccgggacccgacgtcgctgacgctgctgcaccaggacgacgtgggcgggctgcaggtgtgcgccggcggcggcggtggtggtgagtggcgcgcggtgcggccccgcgcggacgcgttcgtggtcaacatcggcgacaccttcgccgcgctcaccgacgggcgccacgccagctgcctccaccgcgccgtggtcagcggtgaccgcgcccgcaggtcgctcgccttcttcttcaacccgccgctcgaccgcgtcgtccgcccgccggacgcgctcctcctcgaggacgagaagcgccgccgcccgcgcgcgttcccggacttcacgtggcgcgagttcctcgagttcacgcagaagcattaccggtcggacgcgagcaccatggacgccttcgtgtcgtggatcgccggaggacgcggcgatggccatggcggcagacaggagggcaagtga

SEQ ID NO: 403 - protein, 382 aa, Sorghum bicolor
MAAAGVVVFDAEVLSREERIPAQFVWPAEDRAPSAGGCGVEEIAIPVVDLGEFLRHGDRELPRGVAEACERHGFFQVVNHGVPAALLADAYRCLDAFYARPLADKQRAQRRPGESHGYASSFTGRFRSCLPWKETLSFNCPAGTGGDTQSAAAVVDYFVDVLGEDYRHMGEVYQEYSDEMARLAMDVTEVLAAALGLRRGALRGFFDGGDSIMRLNHYPACRQPQLTLGTGPHRDPTSLTLLHQDDVGGLQVCAGGGGGGEWRAVRPRADAFVVNIGDTFAALTDGRHASCLHRAVVSGDRARRSLAFFFNPPLDRVVRPPDALLLEDEKRRRPRAFPDFTWREFLEFTQKHYRSDASTMDAFVSWIAGGRGDGHGGRQEGK

SEQ ID NO: 404 - DNA, 1113 bp, Sorghum bicolor
atggtggtcctcaccaagggcgagctggagcagatcacgctcccggccgtgcaacgcgcggcgccgccgctggccttcgtgccggaggtcgacctgtccgcggcggcggcgtccgtcgccgcccggtcggcggccgcgcgcgcggtggccaaggcgtgcgaggaccacgggttcttcaaggtgacgggccacggcgtgccggcgccgctcctggcgcgcctcgaggccgccgccgccgccttcttcgcgctcccgcagcgggacaaggacaaggccgcggccgccgctgttggcgggagcccgccgtttgggtacgccagcaagcggattggcggcaacggcgatctcggctgggttgagtacctcctgcttggcgtcacccccgccggcgccgccgctgcaccctcggcgttgtccgccgcgccagtgtcgtctgcgtccgagggcgccgcgccatcctgttgtttccgtgatgttctggacgagtacatcgcggcggtgcgacgcatgacgtgcacggtgctggagctgatggcgcaaggcctgggcctggacgacgacacggccgtgttcagcaggctggtgctggaccgggacagcgactccatgctgagggtgaaccactacccgccgcggcccgagaccgccgccgccgccggcgagccggcggaggtgaggcggccgcggctgacggggttcggcgagcacaccgacccgcagatcatctccgtgctccggtccaacgacacggccgggctggagatctcgctccgggatggctcctgggtctccgtcccctccgacacccaatccttcttcgtcaacgtcggcgacgcattgcaggtgctgacgaacgggcggttccggagcgtgcggcaccgggtgatggtgagcagcgggcggccgcgggtgtcggtcatcttcttcggcgggccgccgccgcgggagcgcctggcgccgctgccggggctggtggacagggagggcggccgccgacggtacagggagttcacgtggagggagtacaagacctcggcgtaccggaccaagctcgccgacaacaggctctgctacttcgagacgacgaccgccgccgccgccgcgaccagctag

SEQ ID NO: 405 - protein, 370 aa, Sorghum bicolor
MVVLTKGELEQITLPAVQRAAPPLAFVPEVDLSAAAASVAARSAAARAVAKACEDHGFFKVTGHGVPAPLLARLEAAAAAFFALPQRDKDKAAAAAVGGSPPFGYASKRIGGNGDLGWVEYLLLGVTPAGAAAAPSALSAAPVSSASEGAAPSCCFRDVLDEYIAAVRRMTCTVLELMAQGLGLDDDTAVFSRLVLDRDSDSMLRVNHYPPRPETAAAAGEPAEVRRPRLTGFGEHTDPQIISVLRSNDTAGLEISLRDGSWVSVPSDTQSFFVNVGDALQVLTNGRFRSVRHRVMVSSGRPRVSVIFFGGPPPRERLAPLPGLVDREGGRRRYREFTWREYKTSAYRTKLADNRLCYFETTTAAAAATS

SEQ ID NO: 406 - DNA, 738 bp, Sorghum bicolor
atgttgatgctttttcttcactgttgttgcagtaatgtggtgaacgagtatgtgggagcaatgaggcagcttgcatgtgagatcctggacctgttaggagaggggctagggctcaaggaccccagatccttcagcaagctcatcactgacacagacagcgactcactcctgaggatcaaccactaccctccagcatgcaccattcagaagcttgaccatgacaaccaatgcaagatgaagagcagtttcagaatcaagactggcaatggtgtgaaccagtcagcaggtgcacggatcggattcggggagcattcagacccgcagattcttagcttgctccgatcaaacgatgttgacggccttcaggtgcttctgaactgcgacggcagggaggtgtgggttcaggtgccatccgatccatcagcattctttgtcaatgttggtgatctcctccaggctttgacaaatgggaaggtgataagtgtccggcacagggtaattgcaaactcctgcagggcaaggctgtccacaatctacttcgctgcgccgccactgcatgcacgaattttggccctcccagagacaatcacagccaactcaccccgccagtaccggcccttcacctgggccgagtacaagaagacaatgtactccctccgcctgagccacagccgcctcaacctcttccacatcgaccatgatgaccacagcaatgtcggcaaaggagaacaagaatag

SEQ ID NO: 407 - protein, 245 aa, Sorghum bicolor
MLMLFLHCCCSNVVNEYVGAMRQLACEILDLLGEGLGLKDPRSFSKLITDTDSDSLLRINHYPPACTIQKLDHDNQCKMKSSFRIKTGNGVNQSAGARIGFGEHSDPQILSLLRSNDVDGLQVLLNCDGREVWVQVPSDPSAFFVNVGDLLQALTNGKVISVRHRVIANSCRARLSTIYFAAPPLHARILALPETITANSPRQYRPFTWAEYKKTMYSLRLSHSRLNLFHIDHDDHSNVGKGEQE

SEQ ID NO: 408 - DNA, 1113 bp, Sorghum bicolor
atgcgttacgtagctgccactccgaccatgccggccttgacgacgacgaccgcggagagcgccgccgaaccgcctctggcggacagctacctcgacctgctccgccgcggcggcattgcaacgccaccgcggaccgagggccgctgctgcgtgcaggagcgcgagctgccgttgatcgacctgtcgtgcctgcagcagaggagcggcggcggcggcggcagcgcgagggcggcgtgcgcggacgccatggcgcgggcggcctcggagtggggcttcttccaggtgaccgggcacggcgtgagccgggcgctgctggagcggctgcgggcggagcaggcgcggctgttccggctgccgttcgaaaccaaggccaaggccgggctgctcaacggctcctaccgctggggcgcccccacggcggccacgtcgctccgccacctctcgtggtccgaggcgttccacgtcccgctcgccagcatctccggtgctgcctgcgacttcggagacctcagctccctcaggggcgtgatgcaggaggtggcggacgcgatgtcgcgggtggccaagaccgtggcggtggcgctggcggggagcctgctgcagggcggcggccacgacgagcacgaggcggcggcggcgttcccggcgggctgcgacgagaccacctgctacctgcggctgaataggtacccggcgtgcccgttcgcggcggacaccttcgggctggtgccccacacggacagcgacttcctcacggtgctgtgccaggaccacgtcgggggcctgcagctcctcaaggacggccgctgggtcgccgtcaagccccgcccggacgcgctcatcgtcaacatcggcgatctgtttcaggcgtggagcaacaaccggtacaagagcgtggagcacaaggtggtggccaacgcgacggcggagcgcttctcggcggcctacttcctgtgcccgtcgtacgactcgcccgtcggcacgtgcggcgagccgtcgccgtatagggacttcaccttcggggagtacaggaggaaggtgcaggaggacgtcaagcggaccggccgaaagattgggctcccaaactttctcaagcagcaatcgcggcagtaa

SEQ ID NO: 409 - protein, 370 aa, Sorghum bicolor
MRYVAATPTMPALTTTTAESAAEPPLADSYLDLLRRGGIATPPRTEGRCCVQERELPLIDLSCLQQRSGGGGGSARAACADAMARAASEWGFFQVTGHGVSRALLERLRAEQARLFRLPFETKAKAGLLNGSYRWGAPTAATSLRHLSWSEAFHVPLASISGAACDFGDLSSLRGVMQEVADAMSRVAKTVAVALAGSLLQGGGHDEHEAAAAFPAGCDETTCYLRLNRYPACPFAADTFGLVPHTDSDFLTVLCQDHVGGLQLLKDGRWVAVKPRPDALIVNIGDLFQAWSNNRYKSVEHKVVANATAERFSAAYFLCPSYDSPVGTCGEPSPYRDFTFGEYRRKVQEDVKRTGRKIGLPNFLKQQSRQ

SEQ ID NO: 410 - DNA, 1149 bp, Sorghum bicolor
atgccggccttcgccgggagcgcagcggagccgccgctggcagacagctactacgcgctgctccgacgccgcggcggcggcggcaataatgatgatgaagaagcatcaggtggcgcctactactacgacacgacgtcgtcgacagtgccatcgtcggacgacgacgtggcggagtgcgagctcccgatgatcgacgtcgggtgcctgacgaccctgacgaggagcgagcacggatcgtcgtcggaggcggagcgggcggcgtgcacggccgccatcgcgcgcgccgccgaggagtggggcttcttccaggtgcgcaaccacggcgtgtcgcaggagctcctggacgagatgcggcgggagcaggcgcgcctgttccgcctgccgttcgaggccaaggccacggccggcctgctcaaccactcctaccgctggggcaccccgaccgcgacgtccccgcagcagctgtcctggtccgaggccttccacgtcccgctcgccggcgtctccggatccgccgccgccggcacctgcgacttcggcgacctcaccaccctcagggatgtgactcgggaggtggcgggcgcgatgtcaaagctggccggcacgctggcgcgcgtcctggcggaggaggcccggccccggccctgcctgcccgcgggcggcggcggcggtggcggtggcgagcgcttcccggaggggtgcgacgagacgacgtgcttcctgcggctgaaccggtacccgccgtgccccatcgccgccgacgccttcggcctggtcccgcacacggacagcgacttcctcaccgtgctctgccaggaccagcaggtcggcggcctgcagctcatgaaggggggcaggtgggtggccgtcaagccaatccccggcgccctcatcgtcaacatcggggacctcttccaggcgtggagcaacaacagatacaagagcgtggagcacaaagtgatgacgaacgccaagacggagcggtactccgttgcctactttctttgcccgtcctacgactcgccgatcggcacgtgcgaggagccttctctttacaggacgttcacgttcggagagtacaggcgaaaggtgcaagaagatgtcaagagaaccgggaagaaggtcggcctccctaattttctcgtgtaa

SEQ ID NO: 411 - protein, 382 aa, Sorghum bicolor
MPAFAGSAAEPPLADSYYALLRRRGGGGNNDDEEASGGAYYYDTTSSTVPSSDDDVAECELPMIDVGCLTTLTRSEHGSSSEAERAACTAAIARAAEEWGFFQVRNHGVSQELLDEMRREQARLFRLPFEAKATAGLLNHSYRWGTPTATSPQQLSWSEAFHVPLAGVSGSAAAGTCDFGDLTTLRDVTREVAGAMSKLAGTLARVLAEEARPRPCLPAGGGGGGGGERFPEGCDETTCFLRLNRYPPCPIAADAFGLVPHTDSDFLTVLCQDQQVGGLQLMKGGRWVAVKPIPGALIVNIGDLFQAWSNNRYKSVEHKVMTNAKTERYSVAYFLCPSYDSPIGTCEEPSLYRTFTFGEYRRKVQEDVKRTGKKVGLPNFLV

SEQ ID NO: 412 - DNA, 1077 bp, Sorghum bicolor
atggaggactacgactacgagccgccgttgatggccacgtacaggcatctcttggacagtcacccgcaccgactggacgtcgtcgatcatcggagcggcgccgacgacgacgaggagggcttcctcctcccggtgatcgacctttccagcctgctggagcagtcatcatcaggcgccgaggcagcagcagagcagtgccgggcgtccatcgtgcgcgccgcctcggagtggggcttcttccaggtgaccaaccacggcgtgccgcaggcgctgctggacgagctgcaccaggcgcaggtcgccgtcttccgccggcccttccacctcaaggcgagccagccgctgctggacttctcgccggagagctaccgctggggcacacccaccgcaacgtgcctcgaccaactctcgtggtccgaggcctaccacatccccacgaccaatacgacggcggcggctgacgacaagaccaggctcgtggtggaggaggtgtccacggcgatgtcgaagctggcgcagcggctggcagggatcctcgtcgcagacctgctgctgggcgacagtagcatcggcgacggcgaggacgacgacacggcagcggcggtggtgtcgcggtgcacgcggagcacctgcttcctaaggctgaaccggtacccgccgtgcccggcgcccagcggcgcctacgggctgtgcccgcacacggacagcgacttcctcaccatcctgcaccaggacggcgtcggcggcctccagctcgtcaaggccgggcggtgggtcgccgtcaagcccaaccccggcgcgctcatcgtcaacgtgggcgacctcctgcaggcgtggagcaacgaccggtaccggagcgtcgagcaccgggtcatggccagcgacgcgcgggagcggttctccgtcgccttcttcctctgccccagctacgacacgctcgtccggccacgctgcggcgccggcggacctcctcgctacgagagcttcaccttcggggagtaccggaaccagatcagggaggacgtcaggctcacgggccgaaagctcggcctgcaacgctttcgcaaaccagagtaa

SEQ ID NO: 413 - protein, 358 aa, Sorghum bicolor
MEDYDYEPPLMATYRHLLDSHPHRLDVVDHRSGADDDEEGFLLPVIDLSSLLEQSSSGAEAAAEQCRASIVRAASEWGFFQVTNHGVPQALLDELHQAQVAVFRRPFHLKASQPLLDFSPESYRWGTPTATCLDQLSWSEAYHIPTTNTTAAADDKTRLVVEEVSTAMSKLAQRLAGILVADLLLGDSSIGDGEDDDTAAAVVSRCTRSTCFLRLNRYPPCPAPSGAYGLCPHTDSDFLTILHQDGVGGLQLVKAGRWVAVKPNPGALIVNVGDLLQAWSNDRYRSVEHRVMASDARERFSVAFFLCPSYDTLVRPRCGAGGPPRYESFTFGEYRNQIREDVRLTGRKLGLQRFRKPE

SEQ ID NO: 414 - DNA, 1089 bp, Sorghum bicolor
atgccggccttcgccgggagcgcagcggagccgccgctggcagacagctactacgcgctgctccgacgccgcggcggcggcggcaataatgatgatgaagaagcatcaggtggcgcctactactacgacacgacgtcgtcgacagtgccatcgtcggacgacgacgtggcggagtgcgagctcccgatgatcgacgtcgggtgcctgacgaccctgacgaggagcgagcacggatcgtcgtcggaggcggagcgggcggcgtgcacggccgccatcgcgcgcgccgccgaggagtggggcttcttccaggtgcgcaaccacggcgtgtcgcaggagctcctggacgagatgcggcgggagcaggcgcgcctgttccgcctgccgttcgaggccaaggccacggccggcctgctcaaccactcctaccgctggggcaccccgaccgcgacgtccccgcagcagctgtcctggtccgaggccttccacgtcccgctcgccggcgtctccggatccgccgccgccggcacctgcgacttcggcgacctcaccaccctcagggatgtgactcgggaggtggcgggcgcgatgtcaaagctggccggcacgctggcgcgcgtcctggcggaggaggcccggccccggccctgcctgcccgcgggcggcggcggcggtggcggtggcgagcgcttcccggaggggtgcgacgagacgacgtgcttcctgcggctgaaccggtacccgccgtgccccatcgccgccgacgccttcggcctggtcccgcacacggacagcgacttcctcaccgtgctctgccaggaccagcaggtcggcggcctgcagctcatgaaggggggcaggtgggtggccgtcaagccaatccccggcgccctcatcgtcaacatcggggacctcttccaggtacagaatctagtatatgatatgaacatatatattccgattccaaacccttcaaaagtgggcttgctgttgctgtcgcgtcgtcggacacgcacagcggcgttcaaggccttgtttacttctaaaatttttttgcaaaatatgaatagtagcattttcgtttgtatttga

SEQ ID NO: 415 - protein, 362 aa, Sorghum bicolor
MPAFAGSAAEPPLADSYYALLRRRGGGGNNDDEEASGGAYYYDTTSSTVPSSDDDVAECELPMIDVGCLTTLTRSEHGSSSEAERAACTAAIARAAEEWGFFQVRNHGVSQELLDEMRREQARLFRLPFEAKATAGLLNHSYRWGTPTATSPQQLSWSEAFHVPLAGVSGSAAAGTCDFGDLTTLRDVTREVAGAMSKLAGTLARVLAEEARPRPCLPAGGGGGGGGERFPEGCDETTCFLRLNRYPPCPIAADAFGLVPHTDSDFLTVLCQDQQVGGLQLMKGGRWVAVKPIPGALIVNIGDLFQVQNLVYDMNIYIPIPNPSKVGLLLLSRRRTRTAAFKALFTSKIFLQNMNSSIFVCI

SEQ ID NO: 416 - DNA, 987 bp, Sorghum bicolor
atggcgctgggatcggagtcacaggcggcgacgaccgcggacccgtcgtgtccgccgttccctctcctggaggacgacggaggccacatccacgagcaggagcaggaggtcccaagtggagccgagctggagctcccgaccgtggacctggatgctccgggggaggcgctggcagcagcgtgccggggactcggcgtgttccgcctcgccaaccacggcgtccccgcgtcgctctccgcgcggctcttcgcgacggcgcgggccgcgctggccggggcgccgttccacgacaagcgcgcgcagccgggctacttctggggcacgccggcgctctcgctccgcgtccgggacgtcaactgggtcgagggcttccacgtcgccctggggggccaccagcagcccgcccccgggccgccgctcggcgacctacttgacctcgcggcggagtacggcgcgcacatggcgcgggtggcgcgggcgctcttcgacgcgctcgccgcgccgctgggcctcggcgcagaccaggcagcgacctacctcgcggagcgcgacgggttcctgcgggtgtaccgctacccgcgatgcccggagcccgggcacctcgggatggaggcccacacggacagctccgtgctctccgtcatcaaccaggacgccgtcggcggcctgcaggtgttccacgacggcgcgtggcgcgacgtcgcgccgggagccggcgagacgggcacgctgctggtcaacctgggcgacatggcgcgggccatcagcggcgacgcgtactgcagcgtgcgccacagggtggcggcgagccaggcggcggagaggctctcgctctgctacttcgcgttcccgcaggacgacgccgtcatcagctgcgctggcggcaggtacaggcccttcacctacgccgagttccgggagcaggtgcaggccgacatcaaggccactgggtccaaggtcggcctcgagcgcttccttcttcgctaa

SEQ ID NO: 417 - protein, 328 aa, Sorghum bicolor
MALGSESQAATTADPSCPPFPLLEDDGGHIHEQEQEVPSGAELELPTVDLDAPGEALAAACRGLGVFRLANHGVPASLSARLFATARAALAGAPFHDKRAQPGYFWGTPALSLRVRDVNWVEGFHVALGGHQQPAPGPPLGDLLDLAAEYGAHMARVARALFDALAAPLGLGADQAATYLAERDGFLRVYRYPRCPEPGHLGMEAHTDSSVLSVINQDAVGGLQVFHDGAWRDVAPGAGETGTLLVNLGDMARAISGDAYCSVRHRVAASQAAERLSLCYFAFPQDDAVISCAGGRYRPFTYAEFREQVQADIKATGSKVGLERFLLR

SEQ ID NO: 418 - DNA, 978 bp, Triticum aestivum
atggtggttcttgccagcacgcccgccgtcgatcacatcccgctcctcaggtcccccgaccccggggactacttctccggcatgccggttgtcgacctctccagccctggcgcgccgcgggccatcgccgacgcctgcgagcgcttcgggttcttcaagctcgtcaaccacggggtgccagcggacacgatggacaggctcgagtcagaggccgtcaggttcttctcgctgccgcaggccgacaaggaccgctccggcccggcctacccgttcggctacggcagcaagcgcatcgggctcaatggcgacatgggctggctcgagtacctcctcctcgccgtcgagtccgcgtcgctctccggcgcctgcaccgtcccgtcctgcgcgctcttggcggcgctgaacgagtacatcgcggcggtgcggaaggtggcggtgcgggtgatggaggcgatggcggaggggctgggcattgcgcccgttgacgcgctgagcgcgatggtgacggcgggggggagcgaccaggtgttccgggtgaaccactacccgccgtgccacgcgctgcaagggctgggctgcagcgccacaggcttcggcgagcacaccgacccgcagctcatctccgtgctgcgctccaacggcacgtccggcctgcagatcgcgctccagaacgggcagtgggtgtccgtgccctcggaccgcgacgccttcttcgtcaacgtcggcgactcgttgcaggtgctgaccaacgggaggttcaagagcgtgaagcacagggtggtggccaacagcctaaagtctagggtttccatgatctactttggagggccagcgatgacacagaggattgcaccattgccgcagctgctgggcgcgggagagcagagcctgtacaaggacttcacatggggcgagtacaagaaggctgcctacaactcgaggctcggggacaacaggctggctcagttccacaggtag

SEQ ID NO: 419 - protein, 325 aa, Triticum aestivum
MVVLASTPAVDHIPLLRSPDPGDYFSGMPVVDLSSPGAPRAIADACERFGFFKLVNHGVPADTMDRLESEAVRFFSLPQADKDRSGPAYPFGYGSKRIGLNGDMGWLEYLLLAVESASLSGACTVPSCALLAALNEYIAAVRKVAVRVMEAMAEGLGIAPVDALSAMVTAGGSDQVFRVNHYPPCHALQGLGCSATGFGEHTDPQLISVLRSNGTSGLQIALQNGQWVSVPSDRDAFFVNVGDSLQVLTNGRFKSVKHRVVANSLKSRVSMIYFGGPAMTQRIAPLPQLLGAGEQSLYKDFTWGEYKKAAYNSRLGDNRLAQFHR

SEQ ID NO: 420 - DNA, 1044 bp, Triticum aestivum
atgccggccttcgccgagagcacggccgagccacctctggcggacagctactacgcgctgctccgcggtggcaacaaagccgacgagtgcgcctcggcgccgccgcctggctgccaggccccgcccgtgtcggaatgcgagctcccgatgatcgacgttgggtgcctgacggcgtgcggcgggggcacggaggagagggcggcatgcgcggcggcgatcgcgtccgcggccgctgaatggggcttcttccaggtggtcaaccacggcgtcaagcaggagctcctggaggcgatgcggcgggagcaggtgcgcctcttccgcctgccgttcgaggccaaggccacggccggccttctcaacgactcctaccgctggggctcccctaccgccacgtcgccaaggcagctgtcctggtctgaggccttccatgtcccgcttgccggcatctccggcagcccttgcagctacggcgagctcaccagcatcagggatgtgacgcaggaggtggcgaacgcgatgtcaaagctggccaacacgctggcgcgcgtcctggcctcgagcctgggacacaccgccggccaacgcttcccggaagggtgcgacgagaggacgtgcttcctccggctgaacaggtacccgccgtgcccgttctcgccggacgccttcggcctggtgccgcacacggacagcgacttcctcaccgtgctctgccaggaccaagtcggcggcctgcagctgatgaagggctcccagtgggtggccgtcaagcccattcccggcgctctcatcgtcaacattggagacctcttccaggcatggagcaacaacagatacaagagcgtggagcacaaagtggtaaccaacgcgacgacggagaggtactccgtggcatatttcctttgcccgtcctacgactcgcccatcggcgcatgcgaggagccttcaccttacaggaccttcaccttcggggagtatcggagaagggtgcaggaagacgtcaagaagatggggaagaagattggccttcccaactttctgctgtag

SEQ ID NO: 421 - protein, 347 aa, Triticum aestivum
MPAFAESTAEPPLADSYYALLRGGNKADECASAPPPGCQAPPVSECELPMIDVGCLTACGGGTEERAACAAAIASAAAEWGFFQVVNHGVKQELLEAMRREQVRLFRLPFEAKATAGLLNDSYRWGSPTATSPRQLSWSEAFHVPLAGISGSPCSYGELTSIRDVTQEVANAMSKLANTLARVLASSLGHTAGQRFPEGCDERTCFLRLNRYPPCPFSPDAFGLVPHTDSDFLTVLCQDQVGGLQLMKGSQWVAVKPIPGALIVNIGDLFQAWSNNRYKSVEHKVVTNATTERYSVAYFLCPSYDSPIGACEEPSPYRTFTFGEYRRRVQEDVKKMGKKIGLPNFLL

SEQ ID NO: 422 - DNA, 1122 bp, Triticum aestivum
atggtggtgccttccacgacgccggcgcggcaagagacggcgaccatgctgcttccaccgccgtccgccggcggcggcgccataccgacggttgacatgtccgcgccccgcggccgcggcgcgctgtcgcggcaggtggcacgtgcgtgcgcggagcagggcttcttccgtgccgtcaaccacggcgtgcctccggcggggcccccggcacggctggacgccgccacctcggcgttcttcgcgctcgcggcacatgacaagcagcgcgccggcccgccgaacccgctcggctacggctgccgcagcatcggcttcaacggcgacgtgggcgagctcgagtacctcctcctccacgccaaccccgccgccgtcgcgcacagggccagctccatcgacaccaacgacccctcacgcttcagttctgttgtgaatgagtatgtggaagcagtgaagcagcttgcatgtgacatcctggacctgttgggagaggggctagggctggaggaccccaggctcttcagcaagctcatcacagaaactgacagtgactccctcttgaggatcaaccactaccctccatcatgcaccgttcacaagcttgaccatgatgaccaatgcaagctcaagggggttgccaggaccaaggctggtagcggtgggaatccagcggcgggtggccggatcgggttcggtgagcactccgacccacagctacttagcttgctccgagcaaacgacgttgatggcttgcaggtgcttctgccggacatcaacggcaaggacacgtggattcaggtgccagcagactcgtcggcctatttcatcaatgttggtgatctccttcaggctctgacaaatgggaggttagtaagcgtccggcacagagtaattgcaagtgcctgcaggccaaggctgtctaccatctactttgcagccccaccactgcatgcacgaatctcggcgctcccagagatggtcacagccggctcaccaccccggtaccggtcattcacctgggccgagtacaagacagcaatgtactcgctccgcctaagccacagccgcctggacctcttccatgttgatgatgacgaaagcggcaatggcagcaaaggaaaataa

SEQ ID NO: 423 - protein, 373 aa, Triticum aestivum
MVVPSTTPARQETATMLLPPPSAGGGAIPTVDMSAPRGRGALSRQVARACAEQGFFRAVNHGVPPAGPPARLDAATSAFFALAAHDKQRAGPPNPLGYGCRSIGFNGDVGELEYLLLHANPAAVAHRASSIDTNDPSRFSSVVNEYVEAVKQLACDILDLLGEGLGLEDPRLFSKLITETDSDSLLRINHYPPSCTVHKLDHDDQCKLKGVARTKAGSGGNPAAGGRIGFGEHSDPQLLSLLRANDVDGLQVLLPDINGKDTWIQVPADSSAYFINVGDLLQALTNGRLVSVRHRVIASACRPRLSTIYFAAPPLHARISALPEMVTAGSPPRYRSFTWAEYKTAMYSLRLSHSRLDLFHVDDDESGNGSKGK

SEQ ID NO: 424 - DNA, 1122 bp, Triticum aestivum
atggtggtgccttccacgacgccggcgcgacaagagacggtgaccacgctgcttccaccgccgtgccccggcggcggcgccataccgacggttgacatgtccgcgccccacggccgcggcgcgctgtcgcggcaggtggcgcgtgcgtgcgcggagcagggcttcttccgtgccgtcaaccatggcgtgcctccagcgggacccgcggcacggctggacgccgccacctcggcgttcttcgcgctcgcggcacacgacaagcagcgcgccggcccgccgagcccgctcggctacggctgccgcagcatcggcttcaacggcgacttcggcgagctcgagtacctcctcctccacgccaaccccgccgccgtcgcgcacagagccagctccatcgacaccaacgacccctcacgcttcagttctgttgtgaatgagtatgtggaagcagtgaagcagcttgcatgtgacatcctggacctgttgggagaggggctagggctggaggaccccaggctcttcagcaagctcatcacagaaactgacagtgactccctcctgaggatcaaccactaccctccatcatgcaccgttcacaagcttgaccatgatgaccaatgcaagctcaagggggttgccaggaccaaggctggtaacggtgggaatccggcggcgggtggccggatcgggttcggtgagcactccgacccacagctacttagcttgctccgagcaaacgacgttgatggcttgcaggtgcttctgccggacatcaacggcaaggatgtgtggattcaggtgccagcagactcttcggcctatttcgtcaatgttggtgatctccttcaggctctgacaaatgggaggttagtaagcgtccggcacagagtaattacaagtgcctgcaggccaaggctgtccaccatctactttgcagccccaccactgcatgcacgaatctcagcgctcccagagatggtcacagccggctcaccaccccggtaccggtcattcacatgggccgagtacaagacagcaatgtactcgctccgcctaagccacagccgcctggacctcttccatgttgatgatgacgaaagcggcaacggcagcaaaggaaaataa

SEQ ID NO: 425 - protein, 373 aa, Triticum aestivum
MVVPSTTPARQETVTTLLPPPCPGGGAIPTVDMSAPHGRGALSRQVARACAEQGFFRAVNHGVPPAGPAARLDAATSAFFALAAHDKQRAGPPSPLGYGCRSIGFNGDFGELEYLLLHANPAAVAHRASSIDTNDPSRFSSVVNEYVEAVKQLACDILDLLGEGLGLEDPRLFSKLITETDSDSLLRINHYPPSCTVHKLDHDDQCKLKGVARTKAGNGGNPAAGGRIGFGEHSDPQLLSLLRANDVDGLQVLLPDINGKDVWIQVPADSSAYFVNVGDLLQALTNGRLVSVRHRVITSACRPRLSTIYFAAPPLHARISALPEMVTAGSPPRYRSFTWAEYKTAMYSLRLSHSRLDLFHVDDDESGNGSKGK

SEQ ID NO: 426 - DNA, 1092 bp, Triticum aestivum
atgccggccttcgccgagccagccattgatccgcctctggcggacagctaccgcgcgctgctgcgcagcgaccagctccaccgcggcggcattgcgccggcgctgtcgccggcggtgctggagagcgtggccgtgctggagcgcgacctgccgatgatcgacttgaagcgcctgacgagcggcgacgcgtgggagaggaaggcgtgcgcggacgccatggcttgcgcggcgtcggagtggggcttcttccaggtgatcaaccacggcgtggggcgcgagctcctggaggagatgaggcgcgagcaggcgcggctgttccgcctgccgttcgacaccaaggagaaggccgggctcctcaacggctcgtaccggtggggcaacccgacggctacgtcgctccggcacctctcatggtcggaggccttccacgttccgctcgccagcatctcgcgggaggactgcgactacggaaagctcagctccttgaggggcgtgatgcaggaggtggcggacgcgatgtcgcatgtggcggacacggtggcggcggcgctggcggaggacctggggcacgatgcggggggcggcgagccggcgttcccggcggggtgcgacgggacgacgtgcttcctgcggctcaacaggtacccggcgtgcccgttcgcgccggacaccttcgggctggtgccgcacacggacagcgacttcctcaccatcctctgtcaggaccaggtcgggggcctgcagctcatgaaggactcccgctgggtcgccgtgaaaccccgccccgacgcgctcatcgtcaacatcggcgatctgtttcaggcgtggagcaacaacaggtacaagagcgtggagcacaaagtggtggctaaccccaaggcggagcgcctctccgtcgcctacttcctgtgcccgtcgtacgactcgccggtcagcacatgcggcgaaccgtcggcgtacaggccgtttaccttcggggagtaccggaggaaggtgcaggacgatgtcaagagaaccggcaaaaaaattgggctccccaactttctcaaacagtctcccgttgacggcatgaatcacaccctctgttcttaa

SEQ ID NO: 427 - protein, 363 aa, Triticum aestivum
MPAFAEPAIDPPLADSYRALLRSDQLHRGGIAPALSPAVLESVAVLERDLPMIDLKRLTSGDAWERKACADAMACAASEWGFFQVINHGVGRELLEEMRREQARLFRLPFDTKEKAGLLNGSYRWGNPTATSLRHLSWSEAFHVPLASISREDCDYGKLSSLRGVMQEVADAMSHVADTVAAALAEDLGHDAGGGEPAFPAGCDGTTCFLRLNRYPACPFAPDTFGLVPHTDSDFLTILCQDQVGGLQLMKDSRWVAVKPRPDALIVNIGDLFQAWSNNRYKSVEHKVVANPKAERLSVAYFLCPSYDSPVSTCGEPSAYRPFTFGEYRRKVQDDVKRTGKKIGLPNFLKQSPVDGMNHTLCS

SEQ ID NO: 428 - DNA, 1065 bp, Triticum aestivum
atgccggcctccggcgagggtggcaccacctccgacccccctctggttgacagctatcgcacgctgctccgcaaaggaggtggcgacggctttgtgccggcgctggcggccgagagcctggccgtgctggagtgcgacctgccgatgatcgacttggagcgcctgatgatgggcgacgctagggagaggggcgtgtgtatggacgccatggcgagcgcggcgtcggagtggggcttcttccaggtgatcaaccacggcgtggggcaggagctcctggaggagatgaggcgggagcaggcgcggctatttcaccagccgttcaatatcaaggagaaggccggactcctcaacgggtcgtaccggtgggggaccccgacggcgacgtcgctccggcagctctcgtggtcggaggccttccacgttccgctcgcaagcatctctggggaagacgactgcgggcatgcagagctcagctccctgaggggagtgatgcaggaggtggcggccgcgatgtcgcgggtggcggacacggtggccgggacgctggcgaagaacctcgggcacgagtcgacgttcccggcggcggcggggtgcgacgggacgacgtgcttcctgcggctgaacaggtacccggcgtgcccgttcgcggcggacacgctcggcatggtgccgcacacggacagcgacttcctcaccgtcctttgccaggaccaggttgggggcctggagatcatgaaggactcccactgggtcgctgtgaaaccccacgcccacgcgctcatggtcaacgtcggcgatttgttccaggcgtggagcaacaacagatacaagagcgtggagcacagggtggtggccaactccaaggcggagcgcttctccgtcgcctacttcatgtgcccgccgtgtgactcgcccgtcggcacatgcgccgagccgtcgccgtacaagccgtttaccttcggggagtacaggcgcaaggtgcaggaagatgtcacgcgaacggggaagaagattggtctgtccaactttctcaaaggttctacctttgacggcctggctgaatga

SEQ ID NO: 429 - protein, 354 aa, Triticum aestivum
MPASGEGGTTSDPPLVDSYRTLLRKGGGDGFVPALAAESLAVLECDLPMIDLERLMMGDARERGVCMDAMASAASEWGFFQVINHGVGQELLEEMRREQARLFHQPFNIKEKAGLLNGSYRWGTPTATSLRQLSWSEAFHVPLASISGEDDCGHAELSSLRGVMQEVAAAMSRVADTVAGTLAKNLGHESTFPAAAGCDGTTCFLRLNRYPACPFAADTLGMVPHTDSDFLTVLCQDQVGGLEIMKDSHWVAVKPHAHALMVNVGDLFQAWSNNRYKSVEHRVVANSKAERFSVAYFMCPPCDSPVGTCAEPSPYKPFTFGEYRRKVQEDVTRTGKKIGLSNFLKGSTFDGLAE

SEQ ID NO: 430 - DNA, 1074 bp, Triticum aestivum
atgctggccttcgccaagcgcacgagctgcacgaccaccgatccgcctctggcggatagctaccgtgcgctgctctgcagaggcaagctcgagggtggcggcgctgcgtcggcgcatgcggtggagagcctggccatgctggagcgtgacctgccaattatcgacttgaagcgcctggcgagccgcgacgcgagggagagcaaggcgtgcgcggaggccatggcgagagctgcgtcggagtggggcttcttccaggtggtcaaccacggcgtggggcgggagcttttagaggagatgaggcgggagcaggcgaggctgttccgcctgccgttcggtaccaaggacaaggccgggctcctcaacggctcgtaccggtggggcaacccgacggccacgtcgctcgggcagctctcgtggttcgagtccttccacgttccgctccccagcatctcccgggaagactgcgaccgcggaaagctcagcacgttgaggggagtgatgcaggaggtggcggacgcgatgtcgcaggtggcgggcacggtggccgggatgctggcggagaacctcgggcacgaggcaggcggcgagtcggcgttcccggcagggtgcgacgggacgacgtgcttcctgcggcttaacaggtacccggcgtgcccgtttgcggcggactccttcggcatggtgccgcacacggacagcgacttcctcaccatcctctgccaggaccaggtcggggggctacagctcatcaaggactcccgctgggtcgccgtgaagccccacgccgacgcgctcattgtcaacgtcggcgatctgtttcaggcgtggagcaacaacaggtacaagagcgtggagcataaggtggtggccaattccaaggcggagcgtttctccgtcgcctacttcctgtgcccgtcgtcggactcgtccgtcggaacatgcggcgagccgtcgccgtacaagccgtttacctttggagagtataggaggagtgtacaggatgatgtcaagagaaccgggaaaaagattggactccccaactttctcaaacgttctacggttcacggcctcgat

SEQ ID NO: 431 - protein, 358 aa, Triticum aestivum
MLAFAKRTSCTTTDPPLADSYRALLCRGKLEGGGAASAHAVESLAMLERDLPIIDLKRLASRDARESKACAEAMARAASEWGFFQVVNHGVGRELLEEMRREQARLFRLPFGTKDKAGLLNGSYRWGNPTATSLGQLSWFESFHVPLPSISREDCDRGKLSTLRGVMQEVADAMSQVAGTVAGMLAENLGHEAGGESAFPAGCDGTTCFLRLNRYPACPFAADSFGMVPHTDSDFLTILCQDQVGGLQLIKDSRWVAVKPHADALIVNVGDLFQAWSNNRYKSVEHKVVANSKAERFSVAYFLCPSSDSSVGTCGEPSPYKPFTFGEYRRSVQDDVKRTGKKIGLPNFLKRSTVHGLD

SEQ ID NO: 432 - DNA, 1056 bp, Triticum aestivum
atggtggttcttgccaagggcgagctggagcagatcgcgctcccggccgtgcacaagacggcgccgccgctggccgacgtgccggaggtcgaccttgccgtggcgggtcgcggctctgagggacgggcggccgccgcgcgcgctgtggcggcggcgtgcgaggagcacgggttcttcaaggtgacgggccacggcgtgccggcagagctcctggcgcgcgtcgagaacgccgctgccgccttcttcgcgctctcgcagcgggacaaggaggcggcgatgtcggccgcgacgccgggcagtccgttcggctacgcaagcaagcggataggcaacaacggcgacctcgggtgggtcgagtatctcctgctcggtgtcaccgcggcgaccggcgggccattgtccgtgcccgaaggggtggtgccgtcggcgtcgctctgctctttccgcgaccttctgaacgagtacacggaggtcgtgaggaggatgacctgccaggtgctagagctgatggcggagggcctgggcatggacgacagggacgcgttcacgaggctggtcctgcacaaggaaagcgactcgatgctgcgggtgaaccactacccgccgcgccccgagctgaagctcctgcagcagcacggcggtggcggcagggtcaccgggttcggcgagcacaccgacccccagatcatctccgtgctccgctccaacgccacctccggcctcgagatcgcgctgcgcgacggcgcctgggtctctgtgccgccggaccacacttccttcttcgtcaacgttggcgacgccttgcaggtagtactgacgaacgggaggttccggagcgtgaggcaccgggtgatggtgaacagcgcccggccgcgggtgtcggtgatcttcttcggcggcccgccgccgcgggagacgctggcgccgctgccgcagctcgtcggggaaggcgggcgcagccggtacagggagttcacatggcgggagtacaaggcctcggcgtaccggaccaagctggcggcgaacaggctctgccacttcgagaccaccagctag

SEQ ID NO: 433 - protein, 351 aa, Triticum aestivum
MVVLAKGELEQIALPAVHKTAPPLADVPEVDLAVAGRGSEGRAAAARAVAAACEEHGFFKVTGHGVPAELLARVENAAAAFFALSQRDKEAAMSAATPGSPFGYASKRIGNNGDLGWVEYLLLGVTAATGGPLSVPEGVVPSASLCSFRDLLNEYTEVVRRMTCQVLELMAEGLGMDDRDAFTRLVLHKESDSMLRVNHYPPRPELKLLQQHGGGGRVTGFGEHTDPQIISVLRSNATSGLEIALRDGAWVSVPPDHTSFFVNVGDALQVVLTNGRFRSVRHRVMVNSARPRVSVIFFGGPPPRETLAPLPQLVGEGGRSRYREFTWREYKASAYRTKLAANRLCHFETTS

SEQ ID NO: 434 - DNA, 1077 bp, Triticum aestivum
atgctggccttcgccgagggcacgagctgcacgaccaccgatccgcctctggcggacagctaccgcgcgctgctctgcagaggcgagctcgagggcgtcggcgctgcgtcggcgcatgcggtggagagcctggccatgctggagcgtgatctgccgatcatcgacttggagcgcctggcgagccgcgactcgagggagagcaaggcgtgcgcggacgccatggcgagagcggcgtcagagtggggcttcttccaggtggtcaaccacggcgtggggcgggacctcctggaggagatgaggcgggagcaggcgaagctattccgcctgccgttccgtaccaaagacaaagccgggctcctcaatggctcgtaccggtggggcaacccgacggccacgtcgctcgggcagctctcgtggtcggagtccttccacgttccgctccccagcatctcccgggaagactgcgactacggaaagctcaactccttgaggggagtgatgcaggtggtggcggacgcgatgtcgcgagtggcgtacacggtggccgggactcttgcggagaacctcgggcacgaggcagggggcggcgagccggtgttcccggcagggtgcgacgggacgacgtgcttcctgcggctgaacaggtacccggcgtgcccgttcgcggcggacttcttcggcatggtgccgcacacggacagcgacttcctcaccatcctctgccaggaccaggtcgggggcctacagctcatcaaggactcccactgggtcgccgtgaagccccgcgccgacgcgctcattgtcaacgtcggcgatctgtttcaggcgtggagcaacaacaggtacaagagcgtggagcacaaggtggtggccaactccaaggcggagcgcttctccatcgcctacttcatgtgcccgttgtcggactcgccagtcggcacatacggggagccctcgccgtacaagccgtttaccttcgaggagtataggaggagtgtgcgggatgatgtcgagagaaccgggaaaaagattggactccccaactttctcaaacgttcaaccgttcacggcctcgat

SEQ ID NO: 435 - protein, 359 aa, Triticum aestivum
MLAFAEGTSCTTTDPPLADSYRALLCRGELEGVGAASAHAVESLAMLERDLPIIDLERLASRDSRESKACADAMARAASEWGFFQVVNHGVGRDLLEEMRREQAKLFRLPFRTKDKAGLLNGSYRWGNPTATSLGQLSWSESFHVPLPSISREDCDYGKLNSLRGVMQVVADAMSRVAYTVAGTLAENLGHEAGGGEPVFPAGCDGTTCFLRLNRYPACPFAADFFGMVPHTDSDFLTILCQDQVGGLQLIKDSHWVAVKPRADALIVNVGDLFQAWSNNRYKSVEHKVVANSKAERFSIAYFMCPLSDSPVGTYGEPSPYKPFTFEEYRRSVRDDVERTGKKIGLPNFLKRSTVHGLD

SEQ ID NO: 436 - DNA, 1056 bp, Triticum aestivum
atggtggttcttgccaagggcgaactggagcagatcgcgctcccggccgtgcacaagacggcgccgccgctggccaacatgccggaggtcgaccttgccgtggcgggaagcggctctgatggacgggcggccgccggacgcgcggtggcggcggcgtgcgaggagcacgggttcttcaaggtgacgggccaccgcgtgccagcagagctcctggcgcgcgtggagaacgccgctgccgccttcttcgcgctctcgcagcgggacaaggaggcggcgatgtcggccgcgacgccgggcagtccgttcggctacgcaagcaagcggataggcaacaacggcgacctcgggtgggtcgagtatctcctgctcggtgtcaccgcctcgacgggcgggccattgtccgtgcccgaaggggtggtgccgtcagcgtcgctctgctctttccgcgaccttctgaacgagtacacggtggccgtgaggaggatgacctgccaggtgctggagctgatggcggagggcctgcgtatggaagacagggacgcgttcacgaggctggtcctgcacaaggaaagcgactcgatgctgcgggtgaaccactacccaccgcgccccgagctgaagctcctgcagcagcagcacggcggcggcggcagggtcactgggttcggcgagcacaccgacccccagatcatctcggtgctccgctccaacgccacctccggcctcgagatcgcgctgcgcgacggcgcctgggtctccgtgccgccggaccagacctccttcttcgtcaacgtcggcgacgccttgcaggtactgacgaacgggaggttccggagcgtgaggcaccgggtgatggtgaacagcgtccggccgcgggtgtcggtgatcttcttcggcggcccggcgccgcgggagacgctggcgccgctgcggcagctcgtcggggaaggcgggcgcagccggtacagggagttcacatggcgagagtacaaggcctcggcgtaccggaccaagctggcggcgaacaggctcggccacttcgagaccaccagctag

SEQ ID NO: 437 - protein, 351 aa, Triticum aestivum
MVVLAKGELEQIALPAVHKTAPPLANMPEVDLAVAGSGSDGRAAAGRAVAAACEEHGFFKVTGHRVPAELLARVENAAAAFFALSQRDKEAAMSAATPGSPFGYASKRIGNNGDLGWVEYLLLGVTASTGGPLSVPEGVVPSASLCSFRDLLNEYTVAVRRMTCQVLELMAEGLRMEDRDAFTRLVLHKESDSMLRVNHYPPRPELKLLQQQHGGGGRVTGFGEHTDPQIISVLRSNATSGLEIALRDGAWVSVPPDQTSFFVNVGDALQVLTNGRFRSVRHRVMVNSVRPRVSVIFFGGPAPRETLAPLRQLVGEGGRSRYREFTWREYKASAYRTKLAANRLGHFETTS

SEQ ID NO: 438 - DNA, 723 bp, Triticum aestivum
atgtgtgtggatgcaggcagttctgttgtgaatgagtatgtggaagcagtgaagcagcttgcatgtgacatcctggacctgttgggagaggggctagggctggaggaccccaggctcttcagcaagctcatcacagaaactgacagtgactccctcctgaggatcaaccactaccctccatcatgcaccgttcacaagcttgaccatgatgaccaatgcaagctcaagggggttgccaggaccaaggctggtagcggtgggaatccggcggcgggtggccggatcgggttcggtgagcactctgacccacagctacttagcttgctccgagcaaacgacgttgatggcttgcaggtgcttctgccggacatcaacggcaaggacacgtggattcaggtgccagcagactcgtcggcctatttcgtcaatgttggtgatctccttcaggctctgacaaatgggaggttagtaagcgtccggcacagagtaattgcaagtgcctgcaggccaaggctgtccaccatctactttgcagccccaccactgcatgcacgaatttcggcgctcccagagatggtcacagccgactcaccaccccggtaccggtcattcacctgggccgagtacaagacagcaatgtactcactccgcctaagccacagccgcctggagctcttccatgttgatgatgacgaaagcggcaatggcagcaaaggaaaataa

SEQ ID NO: 439 - protein, 240 aa, Triticum aestivum
MCVDAGSSVVNEYVEAVKQLACDILDLLGEGLGLEDPRLFSKLITETDSDSLLRINHYPPSCTVHKLDHDDQCKLKGVARTKAGSGGNPAAGGRIGFGEHSDPQLLSLLRANDVDGLQVLLPDINGKDTWIQVPADSSAYFVNVGDLLQALTNGRLVSVRHRVIASACRPRLSTIYFAAPPLHARISALPEMVTADSPPRYRSFTWAEYKTAMYSLRLSHSRLELFHVDDDESGNGSKGK

SEQ ID NO: 440 - DNA, 558 bp, Triticum aestivum
atggatgtgacgcaggaggtggcgaacgcgatgtcaaagctggccaacacgctggcgcgcgtcctggccgagagcctgggacacaccgccggccaacgcttcccgaaagggtgcgacgagaggacgtgcttcctccggctgaacaggtacccgccgtgcccgttctcgccggacgccttcggcctggtgccgcacacggacagcgacttcctcaccgtgctctgccaggaccaagtcggcggcctgcagctgatgaagggctcccggtgggtggccgtcaagcccattcccggcgctctcatcgtcaacattggagacctcttccaggcatggagcaacaacagatacaagagcgtggagcacaaagtggtgaccaacgcgacgacggagaggtactccgtggcatacttcctttgcccgtcgtacgactcgcccatcggcgcatgcgaagagccttcaccttacaggaccttcaccttcggggagtatcggagaagggtgcaggaagatgtcaagaagacggggaagaagattggccttcccaattttctgctgtag

SEQ ID NO: 441 - protein, 185 aa, Triticum aestivum
MDVTQEVANAMSKLANTLARVLAESLGHTAGQRFPKGCDERTCFLRLNRYPPCPFSPDAFGLVPHTDSDFLTVLCQDQVGGLQLMKGSRWVAVKPIPGALIVNIGDLFQAWSNNRYKSVEHKVVTNATTERYSVAYFLCPSYDSPIGACEEPSPYRTFTFGEYRRRVQEDVKKTGKKIGLPNFLL

SEQ ID NO: 442 - DNA, 597 bp, Triticum aestivum
atgcaggaggtggcggacgcgatgtcgcgcgtggcggacacggtggcggcggcgctggcggaggacctcgggcacgatgcgtggggcggcgagccggcgttcccggcggggtgcgacgggacgacgtgcttcctgcggctcaacaggtacccggcatgcccgttcgcgccggacacgttcgggctggtgccgcacacggacagcgacttcctcaccatcctctgccaggaccaggtcgggggcctgcagctcatgaaggactcccgctgggtcgccgtgaaaccccgccccgacgcgctcatcgtcaacatcggcgatctgtttcaggcgtggagcaacaacaggtacaagagcgtggagcacaaagtggtggccaacgccaaggcggagcgcctctccgtcgcctacttcctgtgcccgtcgtacgactcgctggtcggcacatgcggcgagccgtcgccgtacaggccgtttaccttcggggagtaccggaggaaggtgcaggacgatgtcaagagaaccggcaaaaaaattgggctccccaactttctcaaacagtctcccgttgacgccatgaatcacagcctctgtacttaa

SEQ ID NO: 443 - protein, 198 aa, Triticum aestivum
MQEVADAMSRVADTVAAALAEDLGHDAWGGEPAFPAGCDGTTCFLRLNRYPACPFAPDTFGLVPHTDSDFLTILCQDQVGGLQLMKDSRWVAVKPRPDALIVNIGDLFQAWSNNRYKSVEHKVVANAKAERLSVAYFLCPSYDSLVGTCGEPSPYRPFTFGEYRRKVQDDVKRTGKKIGLPNFLKQSPVDAMNHSLCT

SEQ ID NO: 444 - DNA, 579 bp, Triticum aestivum
atgacctgccaggcgctggagctgatggcggagggcctgggcatggacgacagggacgccttcaccaggctggtcctgcacaaggaaagcgactcgatgctgcgggtgaaccactacccgccgcgccccgagctgaagctcctgcagcagcagcagcaacacggcggcggcggcagggtcaccgggttcggcgagcacaccgaccctcagatcatctccgtgctccgctccaacgccacctctggcctcgagatcgcgctgcgcgacggcgcctgggtctccgtgccgccggaccagacctccttcttcgtcaacgtcggcgacgccttgcaggtgctgactaacgggaggttccggagcgtgaggcaccgggtgatggtgaacagcgtccggccgcgggtgtcggtgatcttcttcggcggcccgtcgccgcgggagacgctggcgccgctgccgcagctcgtcggggaaggcgggcgcagccggtacagggagttcacatggcgggagtacaaggcctcggcgtaccggaccaagctggcggcgaacaggctctgccacttcgagaccaccagctag

SEQ ID NO: 445 - protein, 192 aa, Triticum aestivum
MTCQALELMAEGLGMDDRDAFTRLVLHKESDSMLRVNHYPPRPELKLLQQQQQHGGGGRVTGFGEHTDPQIISVLRSNATSGLEIALRDGAWVSVPPDQTSFFVNVGDALQVLTNGRFRSVRHRVMVNSVRPRVSVIFFGGPSPRETLAPLPQLVGEGGRSRYREFTWREYKASAYRTKLAANRLCHFETTS

SEQ ID NO: 446 - DNA, 546 bp, Triticum aestivum
  modified_base (448)..(448): a, c, t, or g
atgcaggaggtggcggacgcgatgtcgcaggtggcgggcacggtggccgggatgctggcggagaacctcgggcacgaggcaggcggcgagtcggcgttcccggcagggtgcgacgggacgacgtgcttcctgcggcttaacaggtacccggcgtgcccgtttgcggcggactccttcggcatggtgccgcacacggacagcgacttcctcaccatcctctgccaggaccaggtcggggggctacagctcatcaaggactcccgctgggtcgccgtgaagccccacgccgacgcgctcattgtcaacgtcggcgatctgtttcaggcgtggagcaacaacaggtacaagagcgtggagcataaggtggtggccaattccaaggcggagcgtttctccgtcgcctacttcctgtgcccgtcgtcggactcgtccgtcggaacatgcggcngagagtataggaggagtgtacaggatgatgtcaagagaaccgggaaaaagattggactccccaactttctcaaacgttctacggttcacggcctcgat

SEQ ID NO: 447 - protein, 182 aa, Triticum aestivum
  MOD_RES (150)..(150): Any naturally occurring amino acid
MQEVADAMSQVAGTVAGMLAENLGHEAGGESAFPAGCDGTTCFLRLNRYPACPFAADSFGMVPHTDSDFLTILCQDQVGGLQLIKDSRWVAVKPHADALIVNVGDLFQAWSNNRYKSVEHKVVANSKAERFSVAYFLCPSSDSSVGTCGXEYRRSVQDDVKRTGKKIGLPNFLKRSTVHGLD

SEQ ID NO: 448 - DNA, 1101 bp, Zea mays
atggtggtgccttccacgacgccggtggtgcgccaagaaacgccaccgccgtcccacgacggcataggcataccgacggtggacctgtcggcgccgggcggccgcggcgcgctgtcgcggcaggtggcgcgcgcgtgcgcgcagcacggcttcttccgggccgtgaaccacggcgtggcgccaggccccgccgcacggctggacgccgccgccaggacgttcttcgcgctggcgccgcacaacaagcagcgcgccggcccgcccagcccactcggatacggctgccgcagcatcggcttcaacggcgacgccggggagctcgagtacctgctgctccacgccaacccggccgccgtcgcgcacagggccagatccatcgacactgatgacccctcgcgcttcagcaatgtggtgaacgagtatgtgggagcgatgaggcagctcgcatgtgagatcctggacctgctcggagaggggctagggctcaaggaccccagatccttcagcaggctcatcgctgacacagacagcgactcactcctgcggataaaccactaccctccaccatgcgccattcacaagcttgaccacgacagtcagtgcaggatgaagaacagtttcaggatcgtggcaggcaatggcgcgaaccagtcggcaggtgcacggatcggattcggggagcactcagacccgcagatccttagcttgctccgatcaaacgatgttgacggccttcaggtgcttctgaacagcgacggcagagaggtgtgggttcaggtgccagccgatccatcagcgttctttgtcaatgttggtgatctcctccaggccttcacaaatgggaaggtgataagcgtccggcacagggtaattgcaagctcgagcagggcgaggctgtcaacgatctacttcgctgcgccgccactgcatgcacgaattttggccctcccagagacagtcacagccaactcacccaggcagtaccggcccttcacctgggccgagtacaagaagacaatgtactccctccgcctcagccacagccgcctcaacctcttccacatcggccatgatgaccacggcaaaggagaacaagaatag

SEQ ID NO: 449 - protein, 366 aa, Zea mays
MVVPSTTPVVRQETPPPSHDGIGIPTVDLSAPGGRGALSRQVARACAQHGFFRAVNHGVAPGPAARLDAAARTFFALAPHNKQRAGPPSPLGYGCRSIGFNGDAGELEYLLLHANPAAVAHRARSIDTDDPSRFSNVVNEYVGAMRQLACEILDLLGEGLGLKDPRSFSRLIADTDSDSLLRINHYPPPCAIHKLDHDSQCRMKNSFRIVAGNGANQSAGARIGFGEHSDPQILSLLRSNDVDGLQVLLNSDGREVWVQVPADPSAFFVNVGDLLQAFTNGKVISVRHRVIASSSRARLSTIYFAAPPLHARILALPETVTANSPRQYRPFTWAEYKKTMYSLRLSHSRLNLFHIGHDDHGKGEQE

SEQ ID NO: 450 - DNA, 1053 bp, Zea mays
atgcgttacgtagctgccactccgaccatgccgtcccttgccgcggagagcgccgccgaaccgcctctggtggacagctacctggagctgctccggcgcggcggcggcggcattgcggcggcgaccgagtgctgcgtgcaggagcgcgagctgcccttgatcgacctgacgtgcctgggcagcgcggacgccatggcgagggcggcctcggagtggggctttttccaggtgaccgggcacggcgtgagccgggcgctgttggagcggctgcgggcggagcaggcgcggctgttccggctgccgttcgaaaccaaggccaaggccgggcttctcaacggctcctaccgctggggcgcccccacggccacgtcgctccgccacctctcgtggtcggaggcgttccacgtcccgctcgccagcatctccggcactgcctgcgacttcggagagctcagctccttgaggggcgtgatgcaggaggtggcggacgcgatgtcgcgggtggccaagaccgtggcggtggcgctggcggggagcctgctgggccacgacgaggcggcggcgttcccggcggggtgcggcgagaccacctgctacctgcggctgaatcggtacccggcgtgcccgttcgcggcgaacaccttcgggctggtgccccacacggacagcgacttcctgacggtgctgtcccaggaccaggtcgggggcctgcagctcatgacggacgccggctgggtggccgtcaagccacgccccgacgcgctcatcgtcaacatcggcgatctgtttcaggcctggagcaacaacctgtacaagagcgtggagcacaaggtggtggccaacgccacggcggagcgcttctcggcggcctacttcctgtgcccgtcctacgactcgctcgtcggcacgtgcggcgagccgtcgccgtacagagacttcaccttcggggagtacaggaggaaggtgcaggaggacgtcaagaggaccggaagaaagattgggctccccaactttctcaaacaccgcccaccccctcaatcacggcccgcctaa

SEQ ID NO: 451 - protein, 350 aa, Zea mays
MRYVAATPTMPSLAAESAAEPPLVDSYLELLRRGGGGIAAATECCVQERELPLIDLTCLGSADAMARAASEWGFFQVTGHGVSRALLERLRAEQARLFRLPFETKAKAGLLNGSYRWGAPTATSLRHLSWSEAFHVPLASISGTACDFGELSSLRGVMQEVADAMSRVAKTVAVALAGSLLGHDEAAAFPAGCGETTCYLRLNRYPACPFAANTFGLVPHTDSDFLTVLSQDQVGGLQLMTDAGWVAVKPRPDALIVNIGDLFQAWSNNLYKSVEHKVVANATAERFSAAYFLCPSYDSLVGTCGEPSPYRDFTFGEYRRKVQEDVKRTGRKIGLPNFLKHRPPPQSRPA

SEQ ID NO: 452 - DNA, 996 bp, Zea mays; identical to SEQ ID NO: 328

SEQ ID NO: 453 - protein, 331 aa, Zea mays; identical to SEQ ID NO: 329

SEQ ID NO: 454 - DNA, 1095 bp, Zea mays
atgccggccttcgcggggggcgcagcggagccgccgctggcagacagctactacgcgctcctccgccgcggcaatgacgatgaaggcgcctacacgacgtcgacagcgccatgggacgacgacgacgacgtctcactgcccgtggcggagtgcgagctcccgatgatcgacgtcgggtgcctgacgagcgccgaccacggaagctccccggaggcggaggcggagcgggcggcgtgcgcggccgccatcgcgcgcgccgccgaggagtggggcttcttccaggtgcgcaaccacggcgtgccgcaggagctcctggaggagatgcgccgggagcaggcgcggctgttccgcctgccgttcgagaccaaggccacggccggcctgctcaacgactcctaccgctggggcaccccgaccgcgacgtctccgcgccagctgtcctggtccgaggccttccacgtcccgctcgccggcgtctccggctccggcaccacctgcgacttcggcgacctcaccaccctcagggatgtgactcgggaggtggcgggcgcgatgtcaaagctggccggcacgctggcgcgcgtcctggcggaggccctcctgggtcggcggcccgccggcgagcgcttcccggaggggtgcgacgagacgacgtgcttcctgcggctgaaccggtacccggcgtgccccatctcccccggcgccttgggcctggtcccgcacacggacagcgacttcctcaccgtgctctgccaggaccagcaggtcggcggcctgcagctcatgaaggggggcaggtgggtggccgtcaagccaatccccggcaccctcgtcgtcaacatcggggacctcttccaggcgtggagcaacaacatatacaggagcgtggagcacaaggtgatgacgaacgccaggacggagcgctactccgtcgcctactttctctgcccgtcctacgactcgccgatcggcacgtgcgaggagccttctctctacaggacgttcaccttcggggagtacaggagaagggtgcaggaggacgtcaagaggaccgggaagaaggtcggcctccctaattttctcgtgcaaacataa

SEQ ID NO: 455 - protein, 364 aa, Zea mays
MPAFAGGAAEPPLADSYYALLRRGNDDEGAYTTSTAPWDDDDDVSLPVAECELPMIDVGCLTSADHGSSPEAEAERAACAAAIARAAEEWGFFQVRNHGVPQELLEEMRREQARLFRLPFETKATAGLLNDSYRWGTPTATSPRQLSWSEAFHVPLAGVSGSGTTCDFGDLTTLRDVTREVAGAMSKLAGTLARVLAEALLGRRPAGERFPEGCDETTCFLRLNRYPACPISPGALGLVPHTDSDFLTVLCQDQQVGGLQLMKGGRWVAVKPIPGTLVVNIGDLFQAWSNNIYRSVEHKVMTNARTERYSVAYFLCPSYDSPIGTCEEPSLYRTFTFGEYRRRVQEDVKRTGKKVGLPNFLVQT

SEQ ID NO: 456 - DNA, 1098 bp, Zea mays
atgccggccttcgcggggggcgcagcggagccgccgctggcagacagctactacgcgctcctccgccgcggcaatgacgatgaaggcgcctacacgacgtcgacagcgccatgggacgacgacgacgacgtctcactgcccgtggcggagtgcgagctcccgatgatcgacgtcgggtgcctgacgagcgccgaccacggaagctccccggaggcggaggcggagcgggcggcgtgcgcggccgccatcgcgcgcgccgccgaggagtggggcttcttccaggtgcgcaaccacggcgtgccgcaggagctcctggaggagatgcgccgggagcaggcgcggctgttccgcctgccgttcgagaccaaggccacggccggcctgctcaacgactcctaccgctggggcaccccgaccgcgacgtctccgcgccagctgtcctggtccgaggccttccacgtcccgctcgccggcgtctccggctccggcaccacctgcgacttcggcgacctcaccaccctcagcagggatgtgactcgggaggtggcgggcgcgatgtcaaagctggccggcacgctggcgcgcgtcctggcggaggccctcctgggtcggcggcccgccggcgagcgcttcccggaggggtgcgacgagacgacgtgcttcctgcggctgaaccggtacccggcgtgccccatctcccccggcgccttgggcctggtcccgcacacggacagcgacttcctcaccgtgctctgccaggaccagcaggtcggcggcctgcagctcatgaaggggggcaggtgggtggccgtcaagccaatccccggcaccctcgtcgtcaacatcggggacctcttccaggcgtggagcaacaacatatacaggagcgtggagcacaaggtgatgacgaacgccaggacggagcgctactccgtcgcctactttctctgcccgtcctacgactcgccgatcggcacgtgcgaggagccttctctctacaggacgttcaccttcggggagtacaggagaagggtgcaggaggacgtcaagaggaccgggaagaaggtcggcctccctaattttctcgtgcaaacataa

SEQ ID NO: 457 - protein, 365 aa, Zea mays
MPAFAGGAAEPPLADSYYALLRRGNDDEGAYTTSTAPWDDDDDVSLPVAECELPMIDVGCLTSADHGSSPEAEAERAACAAAIARAAEEWGFFQVRNHGVPQELLEEMRREQARLFRLPFETKATAGLLNDSYRWGTPTATSPRQLSWSEAFHVPLAGVSGSGTTCDFGDLTTLSRDVTREVAGAMSKLAGTLARVLAEALLGRRPAGERFPEGCDETTCFLRLNRYPACPISPGALGLVPHTDSDFLTVLCQDQQVGGLQLMKGGRWVAVKPIPGTLVVNIGDLFQAWSNNIYRSVEHKVMTNARTERYSVAYFLCPSYDSPIGTCEEPSLYRTFTFGEYRRRVQEDVKRTGKKVGLPNFLVQT

SEQ ID NO: 458 - DNA, 1050 bp, Zea mays
atggtagcgccgtcggcggcggcaggccgggacatggcgccggagtctctcccgctcggcattatcccgacggtggacatgtcggcgccgtcggggcgcggcgagctggcgcgccggctggtgcgcgcctgcgcggagcgcggcttcttcaaggccgtcaaccacggcgtgccgccgcgggtgtccgcccggctggacgccgccacgtcggcgttcttcgcgcgccccgctccggtgaagcaggcggccgggccgccggacccgctggggtatggcagccggaacattggtgccaacggcgacgtcggcgagctggagtacctcatcctgcacgcccaacccgcagcagtggcgcgcaaggccatggtcatcgacgcggaggacccttcgcggttcagtgtagcagtgaacgagtacgtggacgcagtgcggcgtctcgcgtgccgggtcctggacctcctcggcgagggcctcggcctcggggacccgacgtccttgagccgcttcgtctcggccgtcgtcgacagcgactccgtcctcaggatcaaccactaccccacgtccagcgcggcggcggatgtgtctgccaagggcatcgggttcggcgagcacaccgacccgcagatcctcagcctgctccgcgccaacgacgtggacggcctgcaggtgctgctgcccgacgcccgcggcggcagcggcggcgaccagtgggtccaggtgccggctgacccgtccgccttcttcatcaacgtcggtgacgcccttcaggccctgacaaacgggcggttggtgagcatccggcacagggtgatggccagcaccacccggccgcggctgtccaccatctacttcgccgcgccgccgctcgacgcccgcatcgcagcgctcccggagacggtggttgccggcgcggcgcggcggtacaggaccttcacatgggcggagtacaagaaggccatgtacgcgctccgcctcagccacaaccgtcttgatctcttccacgcagacgcatcctccggcggcagcggcgataaaaagcatgatatatag

SEQ ID NO: 459 - protein, 349 aa, Zea mays
MVAPSAAAGRDMAPESLPLGIIPTVDMSAPSGRGELARRLVRACAERGFFKAVNHGVPPRVSARLDAATSAFFARPAPVKQAAGPPDPLGYGSRNIGANGDVGELEYLILHAQPAAVARKAMVIDAEDPSRFSVAVNEYVDAVRRLACRVLDLLGEGLGLGDPTSLSRFVSAVVDSDSVLRINHYPTSSAAADVSAKGIGFGEHTDPQILSLLRANDVDGLQVLLPDARGGSGGDQWVQVPADPSAFFINVGDALQALTNGRLVSIRHRVMASTTRPRLSTIYFAAPPLDARIAALPETVVAGAARRYRTFTWAEYKKAMYALRLSHNRLDLFHADASSGGSGDKKHDI

SEQ ID NO: 460 - DNA, 1122 bp, Zea mays; identical to SEQ ID NO: 338

SEQ ID NO: 461 - protein, 373 aa, Zea mays; identical to SEQ ID NO: 339

SEQ ID NO: 462 - DNA, 1011 bp, Zea mays
atggtggtcctcgccaagggtgagctcgagcagatcgccctcccggctgcagagccgcccccggccgacgtgcggtcggtggacctgtccgccccggcgggccccgcgcgcgaggccgcggcgcgcgcgctggtggcggcgtgcgaggagcacgggttcttccgggtgacgggccacggcgtgccggccagactcgtgcgcgccgcggaggccgcggcggccgggttcttcgcgcggccgcagggcgagaaggaggaggagggccccacgctcgggtacggaagcaagcgcatcggcggcaacggcgacctcggctgggtcgagtacctcctgctcggtggcacacccgccgccgcgccttcctcggcattattgccctgcgccgccgccccgtcgccgtccgcgccggccgggccgttacgggaccttctggacgagtacacggtggcggtgcggcggatggcgtgcgcggtgctggagctgatggcggaggggctgggcatcgccggcggcgccggggacgcggtgctggcgcggctggtggcgcgcgcggacagcgactgcatgctgcgggtgaaccactacccgccgcggccggcgctcaaccccagcctcacggggttcggcgagcacaccgacccgcagatcatctcggtgctccgcgccaacggcacctccggcctggagatcgcgctgcgggacggcgcctgggcctccgtcccgcccgacggggacgccttcttcgtcaacgtcggcgacaccctgcaggtgttgacgaacgggaggttcaggagcgtgaggcacagggtggtggtgaacagcgagaagtcccgggtgtccatggtcttcttcggcggcccgccgcccggcgagaggctgggcccgctgccgcagctcctgggcgacggcggccggagccggtaccgggacttcacctggagcgagttcaagaccagcgggtgcaggaccaggctcgcggaagaccgcctgtcccgcttcgagaagaagtag

SEQ ID NO: 463 - protein, 336 aa, Zea mays
MVVLAKGELEQIALPAAEPPPADVRSVDLSAPAGPAREAAARALVAACEEHGFFRVTGHGVPARLVRAAEAAAAGFFARPQGEKEEEGPTLGYGSKRIGGNGDLGWVEYLLLGGTPAAAPSSALLPCAAAPSPSAPAGPLRDLLDEYTVAVRRMACAVLELMAEGLGIAGGAGDAVLARLVARADSDCMLRVNHYPPRPALNPSLTGFGEHTDPQIISVLRANGTSGLEIALRDGAWASVPPDGDAFFVNVGDTLQVLTNGRFRSVRHRVVVNSEKSRVSMVFFGGPPPGERLGPLPQLLGDGGRSRYRDFTWSEFKTSGCRTRLAEDRLSRFEKK

SEQ ID NO: 464 - DNA, 1116 bp, Zea mays; identical to SEQ ID NO: 344

SEQ ID NO: 465 - protein, 371 aa, Zea mays; identical to SEQ ID NO: 345

SEQ ID NO: 466 - DNA, 1188 bp, Zea mays
atgagatctgatggatggcgatatctaacaaatgaagaaaaagctggaagcctagcttcgccgccgtccacgtcgtctcgtcttccttttggaacaaggtcttcgtcgatgcaacaatcctcggccgcctcgatggcaatggaggaagacgacgactacgagccgccgttgatggccacgtacaagcatctgttggacagtcacccgcaccgacaactgggcgccggcgccgcgcaagacgacgaggattgcttcctcctcccggtgatcgacctttccagcctcctgccgccggtgcatcatcgcaagcagtcagcagctgcagagcagtgccgggcgtccatcgtgcgcgccgcctccgagtggggcttcttccaggtgaccaaccacggcgtgccgcaggttctgctggacgagctgcaccaggcgcaggccggcgtcttccgccggcccttccaactcaaggcgcaccagccgctgctggacttctcgccggagagctaccgctggggcacgcccaccgccacgtgcctggagcagctctcgtggtccgaggcctaccacatccccacaacgacgaccacgaccggtaacgacgacaagacccggctagtggtcgaggaggtgtcgacggcgatgtcgaagctggcgcagcggctggcggggatcctcgtcgcggagctgggcgaagacagcgcggcggcggtggtgtcgcggtgcacgcggagcacctgcttcctgcggctgaaccggtacccgccgtgcgcggcggcggccagcggcgtcgtctacgggctgtgcccacactcggacagcgacttcctgaccatactccaccaggacggcgtcggcggcctccagctcgtcaaggacgggcagtgggtagccgtgaagcccagccccggcgcgctcatcgtcaatgtgggcgacctcctgcaggcgtggagcaacgaccggtaccggagcgtcgagcaccgggtgatggccagcgccacgagggagcggttctccgccgccttcttcctgtgccccagctacgacacgctcatccggccgcgctgcggcgccggcggacctcctcctcgctatgagagcttcaccttcggggagtaccggaaccagatcagggaggacgtcaggctcacgggccgaaagctcggcctgcaacgcttccgcaaagcagagtag

SEQ ID NO: 467 - protein, 395 aa, Zea mays
MRSDGWRYLTNEEKAGSLASPPSTSSRLPFGTRSSSMQQSSAASMAMEEDDDYEPPLMATYKHLLDSHPHRQLGAGAAQDDEDCFLLPVIDLSSLLPPVHHRKQSAAAEQCRASIVRAASEWGFFQVTNHGVPQVLLDELHQAQAGVFRRPFQLKAHQPLLDFSPESYRWGTPTATCLEQLSWSEAYHIPTTTTTTGNDDKTRLVVEEVSTAMSKLAQRLAGILVAELGEDSAAAVVSRCTRSTCFLRLNRYPPCAAAASGVVYGLCPHSDSDFLTILHQDGVGGLQLVKDGQWVAVKPSPGALIVNVGDLLQAWSNDRYRSVEHRVMASATRERFSAAFFLCPSYDTLIRPRCGAGGPPPRYESFTFGEYRNQIREDVRLTGRKLGLQRFRKAE

SEQ ID NO: 468 - DNA, 996 bp, Zea mays; identical to SEQ ID NO: 348

SEQ ID NO: 469 - protein, 331 aa, Zea mays; identical to SEQ ID NO: 349

SEQ ID NO: 470 - DNA, 981 bp, Glycine max
atggtgttgctgtccaaagcaacaacagaacaatactcctacatcaagaactacatgccaactgcattctcctcaacaattcccatagtggacctctccaaacccgatgcaaagaccctcatagtgaaggcttgtgaggagtttggattcttcaaagtcatcaaccatggtgttcccattgaagctatatcccaattggaatccgaagccttcaagttcttctctatgccactcaatgagaaggaaaaagcagggcctcccaaaccatttgggtatggtagcaagaaaattggacacaatggggatgttggttgggttgagtaccttcttctcaacaccaatcaagaacacaacttctctttttatggcaaaaatgctgaaaaatttaggtgtctattaaacagttacatgtcttctgtgagaaaaatggcatgcgagattcttgagttgatggcagaaggattgaagattcagcaaaagaatgtgtttagcaagcttctgatggataaacagagtgactctgttttcagggtgaatcactaccctgcttgtcctgaacttgccgtgaatggtcagaacttgattgggttcggagaacatacagacccacaaatcatttctttacttaggtccaacaacacttcaggccttcagatttttcttagagatggaaactggatttcagtcccacctgatcacaaatctttcttcataaatgttggtgattctcttcaggttatgaccaatggaagatttcggagtgtgagacatagagttttggcaaatggatttaagtctaggctctcaatgatttactttggaggtccacctttgagtgaaaaaatagcgccattaccttctctcatgaaaggaaaagaaagcttatataaagaatttacgtggtttgagtacaagaattcaacctatggttcaagattggctgataataggcttggacattttgagagaattgttgcttga

SEQ ID NO: 471 - protein, 326 aa, Glycine max
MVLLSKATTEQYSYIKNYMPTAFSSTIPIVDLSKPDAKTLIVKACEEFGFFKVINHGVPIEAISQLESEAFKFFSMPLNEKEKAGPPKPFGYGSKKIGHNGDVGWVEYLLLNTNQEHNFSFYGKNAEKFRCLLNSYMSSVRKMACEILELMAEGLKIQQKNVFSKLLMDKQSDSVFRVNHYPACPELAVNGQNLIGFGEHTDPQIISLLRSNNTSGLQIFLRDGNWISVPPDHKSFFINVGDSLQVMTNGRFRSVRHRVLANGFKSRLSMIYFGGPPLSEKIAPLPSLMKGKESLYKEFTWFEYKNSTYGSRLADNRLGHFERIVA

SEQ ID NO: 472 - DNA, 981 bp, Glycine max
atggtgttgctgtccaaggcaacaacagaacaatactcctacatcaagaactacatgccaacggcattctcctcaacaattcccgtagtggacctctccaaaccagatgcaaagaccctcatagtgaaggcttgtgaggaatttggattcttcaaagtcatcaaccatggtgttcccatggaaactatatcccaattggaatctgaagccttcaagttcttctctatgccactcaatgagaaggaaaaagtaggccctcccaaaccatatgggtatggtagcaagaaaattggacacaatggggatgttggttgggttgagtaccttcttctcaacaccaatcaagaacacaacttctctgtttatggcaaaaacgctgagaaatttaggtgtttgttgaacagttacatgtcttctgtgaggaaaatggcatgtgagattcttgagctgatggcagaaggattgaagatacaacaaaaaaatgtgtttagcaagcttcttatggataaagagagtgactctgtttttagggtgaatcactaccctgcttgccctgaacttgtgaatggtcaaaacatgatagggtttggagaacacacggacccacaaatcatttctctacttaggtccaacaatacttcaggccttcagatttttcttagagatggaaactggatttcagtcccacctgatcacaaatctttcttcataaatgttggtgattctcttcaggttatgaccaatggaaggtttcgaagtgtgaaacacagagttttgacaaatggatttaagtctagactctcaatgatttactttggaggtccaccattgagtgagaaaatagtaccattatcttcacttatgaaaggaaaagaaagcttatacaaagagtttacgtggttcgagtataaaaatttaacctatgcttcaagattggctgataataggcttggacattttgagagaattgttgcttcataa

SEQ ID NO: 473 - protein, 326 aa, Glycine max
MVLLSKATTEQYSYIKNYMPTAFSSTIPVVDLSKPDAKTLIVKACEEFGFFKVINHGVPMETISQLESEAFKFFSMPLNEKEKVGPPKPYGYGSKKIGHNGDVGWVEYLLLNTNQEHNFSVYGKNAEKFRCLLNSYMSSVRKMACEILELMAEGLKIQQKNVFSKLLMDKESDSVFRVNHYPACPELVNGQNMIGFGEHTDPQIISLLRSNNTSGLQIFLRDGNWISVPPDHKSFFINVGDSLQVMTNGRFRSVKHRVLTNGFKSRLSMIYFGGPPLSEKIVPLSSLMKGKESLYKEFTWFEYKNLTYASRLADNRLGHFERIVAS

SEQ ID NO: 474 - DNA, 1002 bp, Glycine max
atggttgttttgtctcagccagcattaaaccagtttttccttctgaaaacatgcaagcccacgcccctgttctccgggattcccgtggtcgacctcacggaccccgatgccaagacccacatagtgaaggcctgcagggacttcggcttcttcaagctcgtgaaccacggtgttccattagagttcatggccaatttggaaaacgaaaccctcaggttcttcaaaaaacctcagtccgacaaagacagggctggtccccctgatccttttggctacggcagcaagaggattggccctaacggcgatgtcggttgggtcgaatacctccttctcaacaccaaccctgacgtcatctcccccaagtcacagttcattttccgagaaagtcctcagaatttcagggtggtcgttgaggagtacattagagcgctgaagaacatgtgctatgaggtgttggaattaatggcggagggcttgggaataactcagaggaatgcgttgagtaggttgctgaaggatgagaagagtgattcttgcttcagacttaaccactacccgccatgcccagaggtgcaagcattgaacggcagaaatttggttgggtttggagagcacacagacccacagataatttctgtcttgagatctaacagcacctcaggcctgcaaatctgtctcacagatggcacttgggtttcagtcccacctgatcaaacttcctttttcatcaatgttggtgacactctacaggtgatgactaatgggaggtttaaaagtgtaaagcatagagttttggctgacccaaccaagtcaaggttgtcaatgatctactttggaggagcacccttgagtgaaaagatatcacctttaccttctctcatgttaaaaggagaagagagtttctacaaagaattcacatggtgggaatacaagaaggctgcgtatgcgtcaaggctagcggataataggctcgctccttttgagaaatctgctgctgattaa

SEQ ID NO: 475 - protein, 333 aa, Glycine max
MVVLSQPALNQFFLLKTCKPTPLFSGIPVVDLTDPDAKTHIVKACRDFGFFKLVNHGVPLEFMANLENETLRFFKKPQSDKDRAGPPDPFGYGSKRIGPNGDVGWVEYLLLNTNPDVISPKSQFIFRESPQNFRVVVEEYIRALKNMCYEVLELMAEGLGITQRNALSRLLKDEKSDSCFRLNHYPPCPEVQALNGRNLVGFGEHTDPQIISVLRSNSTSGLQICLTDGTWVSVPPDQTSFFINVGDTLQVMTNGRFKSVKHRVLADPTKSRLSMIYFGGAPLSEKISPLPSLMLKGEESFYKEFTWWEYKKAAYASRLADNRLAPFEKSAAD

SEQ ID NO: 476 - DNA, 1026 bp, Glycine max
atggttgttcattctcaccaatctgcactaaacgagttatttctcgtgaaagcatcatgcaagagcaggttcatgtgggtgcccgaggttgatctcacgcaccccgaggccaagacggtcatagtcaaggcatgtcaagagttcggtttgttcaaggtggtcaactatggtgtaccactggaattgatgacccatttggagaatgaagcactcaagttcttcatgcagtcccaatgtcaaaaagacaaggctggtcctccagacccttatgggtatggaagcaagagaattggcacaaacggtgatctgggttgggttgagtacctactcctcaacacaaaccctgatgttatctctcccaaaacactccaactttttgaacaaaacccagaagtgttcaggtgcgcggtggaggaatacataggggcagtgaagaagatgtgctgtgaagtgttggagctaatggctgatgggttggagatagaaccaaggaacgtgttcagcagaatgataagggatgagagaagcgatagctgctttagaatgaaccggtacccagcatgtccagagcttagagttgaggcattgagtggacgaaatttgattgggttcggagagcacacagacccacagataatatctgtcctgagatccaacaacacatcaggactgcaaatgtgtctccgggatgggacttgggcttctatccaacctgatcacacttcctttttcgtcaatgttggtgaccttttgcaggtgatgacgaatggaagctttaaaagtgttaagcatagggtattagccaattcaagcatgtcaagactttcaatgatctactttggaggaccaccattgaatgaaaagattgcacctttaccttcactcgtgtcaagggaagaagagagtttgtacagagaattgacatggcgggaatacaagaatgcagcatacaagtcaaagctctctgataataggcttagtctttttgacaaatttgctgatcacagtgacaaatctccattgtga

SEQ ID NO: 477 - protein, 341 aa, Glycine max
MVVHSHQSALNELFLVKASCKSRFMWVPEVDLTHPEAKTVIVKACQEFGLFKVVNYGVPLELMTHLENEALKFFMQSQCQKDKAGPPDPYGYGSKRIGTNGDLGWVEYLLLNTNPDVISPKTLQLFEQNPEVFRCAVEEYIGAVKKMCCEVLELMADGLEIEPRNVFSRMIRDERSDSCFRMNRYPACPELRVEALSGRNLIGFGEHTDPQIISVLRSNNTSGLQMCLRDGTWASIQPDHTSFFVNVGDLLQVMTNGSFKSVKHRVLANSSMSRLSMIYFGGPPLNEKIAPLPSLVSREEESLYRELTWREYKNAAYKSKLSDNRLSLFDKFADHSDKSPL

SEQ ID NO: 478 - DNA, 1038 bp, Glycine max
atggttgttctttctcaccaatcagcactaaacgagttatttctcgtgaaaacatgcaagagcacgttcataggggtgcctgaggttgatctcacgcaccccgaggccaagacgaccatagtgaaggcatgtcaagagttcggtttgttcaaggtggtcaaccatggcgtgccgttggagttgatgacccatttggagaatgaagcgctcaagttcttcatgcagccacaatctctgaaagacaaggctggtcctcctgacccttatgggtatggaagcaaaagaattggcaccaacggtgatctgggttgggttgagtatctactcctcaacaccaaccctgatgttatctcccccaaaacacttcaactttttgaacaaaacccagaaatgttcaggtgtggagtggaggaatacataggggcagtgaagaagatttgctgtgaagcgttggagctaatggcagatgggttggaaatagtaccaaggaacgtgttcagcagaatgataagggacgagagaagcgatagttgcttcagaatgaaccggtacccagaatgtccagagcttaaggtagaagctttgagtggtcgaaatttgactgggtttggagaacacacagacccacagataatatctgtactgagatccaacaacacatcaggactgcaaatatgtctcccagatggagatggagatgggactacttgggcttcaatccagcctgatcacacttcctttttcatcaacgttggtgatctcttgcaggtgatgacgaatggaagctttaaaagtgttaagcatagggtattagttgattcaagcatgtcaagactttcaatgatttactttggaggaccacctttaaatgaaaagattgcacctttaccttcactcgtgtcaagggaagaagagagtttgtacagagagttgacatggctggaatacaagaatgctgcatacaagtcaaaactctctgataataggcttagtctctttgataaatctgctgatcacagtgacaaatctccattgtga

SEQ ID NO: 479 - protein, 345 aa, Glycine max
MVVLSHQSALNELFLVKTCKSTFIGVPEVDLTHPEAKTTIVKACQEFGLFKVVNHGVPLELMTHLENEALKFFMQPQSLKDKAGPPDPYGYGSKRIGTNGDLGWVEYLLLNTNPDVISPKTLQLFEQNPEMFRCGVEEYIGAVKKICCEALELMADGLEIVPRNVFSRMIRDERSDSCFRMNRYPECPELKVEALSGRNLTGFGEHTDPQIISVLRSNNTSGLQICLPDGDGDGTTWASIQPDHTSFFINVGDLLQVMTNGSFKSVKHRVLVDSSMSRLSMIYFGGPPLNEKIAPLPSLVSREEESLYRELTWLEYKNAAYKSKLSDNRLSLFDKSADHSDKSPL

SEQ ID NO: 480 - DNA, 984 bp, Glycine max
atggtgttgttgtccaaagcaacaacagaacaatactcctacattaagaactgcatgccaaccaaattttcctcaacaattcccatagtggacctctccaaacctgatgcaaagacccttatagtgaaggcttgtgaggagtttggattcttcaaagtcatcaatcatggtgtctccatggaagctatatccgaattggaatatgaagccttcaaattcttctctatgtcactcaatgaaaaggaaaaagtaggacctcccaatccatttgggtatggtagcaagaaaattggacacaatggggacgttggttggattgagtaccttcttctcaacaccaatcaagaacacaacttctctgtttatggcaaaaaccctgagaaattcaggtgtctgttgaacagttacatgtcttctgtgaggaagatggcatgtgagattcttgagttgatggcagaagggttgaagattcagcaaaaggatgtgtttagcaagcttctaatggataaacaaagtgactctattttcagggtgaatcattaccctgcttgtcctgaaatgactctgaatgatcagaacttgattgggtttggagaacacacagacccacaaatcatctctctgttaagatccaacaacacttcaggccttcagatttatcttagagatggaaattggatttcagtcccaccagatgacaaatccttttttattaacgttggtgattctcttcaggttatgacaaatggaaggttccgaagtgtgagacacagagtgttggcaaatgggttcaagtccaggctttcaatgatttactttggaggtccacctttgagtgagaaaatagcaccattatcctctctcatgaaaggaaaagaaagtctatataaagagtttacctggtttgagtacaaaaaatcaatctacggttcaagattatctaaaaatagacttgaacattttgaaagaattgcagcttcgtaa

SEQ ID NO: 481 - protein, 327 aa, Glycine max
MVLLSKATTEQYSYIKNCMPTKFSSTIPIVDLSKPDAKTLIVKACEEFGFFKVINHGVSMEAISELEYEAFKFFSMSLNEKEKVGPPNPFGYGSKKIGHNGDVGWIEYLLLNTNQEHNFSVYGKNPEKFRCLLNSYMSSVRKMACEILELMAEGLKIQQKDVFSKLLMDKQSDSIFRVNHYPACPEMTLNDQNLIGFGEHTDPQIISLLRSNNTSGLQIYLRDGNWISVPPDDKSFFINVGDSLQVMTNGRFRSVRHRVLANGFKSRLSMIYFGGPPLSEKIAPLSSLMKGKESLYKEFTWFEYKKSIYGSRLSKNRLEHFERIAAS

SEQ ID NO: 482 - DNA, 999 bp, Glycine max
atggcagagcaatcaggaagaaaagtggtggtgttgtccaaagcaacaacagaacaatactctaacatcaagaattgtatgccaaccacattctcctcaacaattcccatagtggacctctccaaacccgatgcaaagaccctcatagtgaaggcttgcgaggagtttggattcttcaaagtcatcaaccatggtgtccccatggaagttatatctgaattggaatctgaagccttcaagttcttttctttgccactcaatgagaaggaaatagttgggcctcctaatccatttgggtatggtaacaagaaaattggacgcaatggggacattggttgtgttgagtaccttctactcagcaccagtcaagaacacaacctctctctttatggcaaaaaccctgagaaattcaggtgtttgttgaacaattacatgtcttctataaggaaaatggcatgtgagattcttgagttgatggcagaagggttgaagattcagcaaaaagatgtgtttagtaagcttttaatagataaacagagtgactctgtttttagggtgaatcattaccctgctaactctaaaattcctgtgaatgatcaaagcttgattgggtttggagaacacaccgacccacaaatcatttctctacttaggtcaaacaatacttcaggccttcagatttgtcttaaagatggagattggatttcagtcccacatgatcagaaatctttcttcatcaatgttggtgattctctccaggttatgaccaatggacgattccatagtgtgaaacatagggttttgactaatgaattcaagtccaggctctctatgatttactttggaggtccacctcttgatgagaaaataacaccattaccgtctatcatgaaagggaaagaaagtctatacaaagaatttacgtggtccgagtacaagaattttacttatggtacaaaattggctgataatagacttggacattttgagagaaattag

SEQ ID NO: 483 - protein, 332 aa, Glycine max
MAEQSGRKVVVLSKATTEQYSNIKNCMPTTFSSTIPIVDLSKPDAKTLIVKACEEFGFFKVINHGVPMEVISELESEAFKFFSLPLNEKEIVGPPNPFGYGNKKIGRNGDIGCVEYLLLSTSQEHNLSLYGKNPEKFRCLLNNYMSSIRKMACEILELMAEGLKIQQKDVFSKLLIDKQSDSVFRVNHYPANSKIPVNDQSLIGFGEHTDPQIISLLRSNNTSGLQICLKDGDWISVPHDQKSFFINVGDSLQVMTNGRFHSVKHRVLTNEFKSRLSMIYFGGPPLDEKITPLPSIMKGKESLYKEFTWSEYKNFTYGTKLADNRLGHFERN

SEQ ID NO: 484 - DNA, 1002 bp, Glycine max
atggttgttctgtctcagccagcattaaaccagtttttccttctgaaaacatgcaagcccacgcccttgttcgcggggattcctgtggtcgacctcacggaccccgatgccaagacccacatagtcaatgcctgcagggacttcggcttcttcaagctcgtgaaccacggtgttccgttacagttcatggccaatttggaaaacgaaaccctcgggttcttcaaaaaacctcaatccgagaaagacagggctggtccccctgacccttttggctacggcagcaagaggattggccctaacggcgatgtcggttgggtcgaatacctccttctcaacaccaaccctgatgtcatctcccccaagtcacagttcattttcagagaaggtcctcagaatttcagggcggtggtggaggaatacattagagcggtgaagaacatgtgctatgaggtgttggaattgatggctgagggattggggataacgcagaggaatgtgttgagtaggttgctgaaggatgagaagagtgattcttgcttcagacttaaccactacccgccatgcccggaggtgcaagcattgaacggaaggaatttggttggatttggagagcacacagacccacagataatttctgtcttgagatctaacagcacctcaggcctgcaaatctgtctcacagatggcacttgggtttctgtcccacctgatcaaacttcctttttcatcaatgttggtgacactcttcaggtaatgactaatgggaggtttaaaagtgtaaagcatagagttttggctgacccaaccaagtcaaggttgtcaatgatctactttggaggaccacccttgtgtgaaaagatagcacctttaccttcactcatgttaaaaggagaagagagtttctacaaagagttcacatggtgggaatacaagaaggctgcgtacgcgtcaaggctagcggataatagactcggcccttttgagaaatctgctgctgattaa

SEQ ID NO: 485 - protein, 333 aa, Glycine max
MVVLSQPALNQFFLLKTCKPTPLFAGIPVVDLTDPDAKTHIVNACRDFGFFKLVNHGVPLQFMANLENETLGFFKKPQSEKDRAGPPDPFGYGSKRIGPNGDVGWVEYLLLNTNPDVISPKSQFIFREGPQNFRAVVEEYIRAVKNMCYEVLELMAEGLGITQRNVLSRLLKDEKSDSCFRLNHYPPCPEVQALNGRNLVGFGEHTDPQIISVLRSNSTSGLQICLTDGTWVSVPPDQTSFFINVGDTLQVMTNGRFKSVKHRVLADPTKSRLSMIYFGGPPLCEKIAPLPSLMLKGEESFYKEFTWWEYKKAAYASRLADNRLGPFEKSAAD

SEQ ID NO: 486 - DNA, 984 bp, Glycine max
atgcttaatgagtcatgtcttgtgaagacatgcaaaccttctatcatgttcactagggttcctgaggtcgatctctcggaccccgaggccaagtcactcattatcaaggccagcaaagagtgtggtttctttaaggtagtccaacatggcgttgcgtttgagttgattacaaatttggagaacgaagtccttagatttttccatcaaccacagccacaaaaggacaaggtggttcctcctgatccttgtggttatggaagcaggaaaattggagccaatggtgatgaaggttggctcgagtacctcctcatcaacactaaccctgatgatccaaagtcacttcacctttttcagcaaaacccagcaaatttcaggtctgctgtggaggattatataggagcagttaagaatttgtgctctgatgtgttggaacttatggctgatgggttgggagttgagccgaggaatgtgtttagtaggcttacaatggatgagagaagcgattgcttattaagggttaatcgctaccccgtatgtgcagagcttgatgaatttgaagcattgagtgaacaatatttaattgggtttggcgaacacacagacccacagataatatctgtactgagatcgaataacagtcacggactacaaatctgtctccgagatggaacttgggcttcaattccaccagatcagacttctttcttcgtcattgttggtgacctcttgcaggtgatgactaatgggagatttaaaagtgtaaagcatagggtattgactgactcaaccatttcaagaatttcaataatctactttggaggaccacccttgaatgaaaatattgctcctttaccttcactcgtgctaaaggaagaagagagtttgtataaagagttaacgtggcaggaatacaagactgctacgttcaagtcaaggttgtctgataataggctaagactctttgagaaatttcctagtgagtga

SEQ ID NO: 487 - protein, 327 aa, Glycine max
MLNESCLVKTCKPSIMFTRVPEVDLSDPEAKSLIIKASKECGFFKVVQHGVAFELITNLENEVLRFFHQPQPQKDKVVPPDPCGYGSRKIGANGDEGWLEYLLINTNPDDPKSLHLFQQNPANFRSAVEDYIGAVKNLCSDVLELMADGLGVEPRNVFSRLTMDERSDCLLRVNRYPVCAELDEFEALSEQYLIGFGEHTDPQIISVLRSNNSHGLQICLRDGTWASIPPDQTSFFVIVGDLLQVMTNGRFKSVKHRVLTDSTISRISIIYFGGPPLNENIAPLPSLVLKEEESLYKELTWQEYKTATFKSRLSDNRLRLFEKFPSE

SEQ ID NO: 488 - DNA, 1071 bp, Glycine max
atggttgccccttgtccaacatccatgatggtaagaaccaagaaaacaaaggccatgggagttccgacgatagacctttccctggaaagatcgaagttggcagaactagtggtgaaagcatgtgaggaatacggtttcttcaaggtggtgaatcacagtgtgccaaaggaggttattgcaagattggaagaggagggaaaggagtttttctccaaaacctcctcggagaagcgccaagctggccctgccaatccttttggctatggctgcagaaatattggccccaatggtgatatgggtcacctcgagtatctcctccttcataccaatcctctttctatatctgagagatccaaaaccatagcaaaagaccctactaagttcagttgtgtcgtgaatgattacatagaagcagctaaggaactaacatgtgagcttcttgatctggtggcggagggtttgtgggtccaagacaaattctcactcagcaagctcatcagagacgttcatagtgactcacttctaaggatcaatcaataccctcccgtgagcctaaagggcaccaagaattgggacacgtccaaagttgaggcacgtcaaatccagagccaaaataataacaacaacaacaacaacaacattggctttggagagcattctgaccctcagatcttgaccatcatgcggtccaacaacgttgatggccttcagatttccacccacgatggcttgtggatccctgtcccccctgaccccaatgaattcttcgttatggttggcgatgccttgcaggttttgacaaatggaaggtttgcaagcgtgagacacagggtgttgacgaacacaacaaaggccagaatgtcaatgatgtactttgcagcaccaccgctgaataggtggatcactccactgccaatgatggtgacaccccacaatccaagtctctataagccctttacgtgggcccaatacaagcaagcagcatactctctaagattgggagacgctcgccttgacctcttcaagatccaacgacaacaagatacccatctcgcacctgcttctccctga

SEQ ID NO: 489 - protein, 356 aa, Glycine max
MVAPCPTSMMVRTKKTKAMGVPTIDLSLERSKLAELVVKACEEYGFFKVVNHSVPKEVIARLEEEGKEFFSKTSSEKRQAGPANPFGYGCRNIGPNGDMGHLEYLLLHTNPLSISERSKTIAKDPTKFSCVVNDYIEAAKELTCELLDLVAEGLWVQDKFSLSKLIRDVHSDSLLRINQYPPVSLKGTKNWDTSKVEARQIQSQNNNNNNNNNIGFGEHSDPQILTIMRSNNVDGLQISTHDGLWIPVPPDPNEFFVMVGDALQVLTNGRFASVRHRVLTNTTKARMSMMYFAAPPLNRWITPLPMMVTPHNPSLYKPFTWAQYKQAAYSLRLGDARLDLFKIQRQQDTHLAPASP

SEQ ID NO: 490 - DNA, 1071 bp, Glycine max
atggttgcgccttgtccaacatccatgatggtaagaaccaagaaaacaaaggccatgggagttccgacaatagacctttcaatggaaaggtccaagttgtcggaactggtggtgaaagcatgtgaggaatatggtttcttcaaggtggtgaaccacagtgtgcaaaaagaggtcattgcaagattggaagaggagggaaaggagtttttctccaaaacctcctcggagaagcgccaagctggccctgccaatccttttggctatggttgcagaaatattggccccaatggcgatatgggtcacctcgagtatctcctccttcataccaaccctctttccatatctgagagatccaaaaccatagcaaatgaccctactaagttcagttgtgccgtgaatgattacatagaagcagttaaagaactaacatgtgaggttctcgatatggtggaggagggtttgtgggtccaagacaagttctcactcagcaagctcatcagagacgtccatagtgactcactcctaaggatcaatcaataccctcccgtgagcctaaagggcaccaagaattgggacacgtccaaacttgaggcacatcaactccagagccaaaataataataacaacaacaacaatattggctttggagagcattctgaccctcagatcttgaccatcatgcggtccaacaacgttgatggccttcagatttccacccacgatggcttgtggatccctgtcccccctgaccccaatgaattcttcgttatggttggtgatgccttgcaggttttgacaaatggaaggtttgtaagcgtgagacacagggtgttgacgaacacaacaaaggccagaatgtcaatgatgtactttgcagcaccaccgctgaattggtggatcactccactgccgaagatggtgacaccccacaatccaagtctctataagcccttcacctgggcccaatacaagcaggcagcatattctctaagattgggagacgctcgccttgacctcttcaagatccaacgacaacaagatacccatctcatcgcacctgcttcaacctga

SEQ ID NO: 491 - protein, 356 aa, Glycine max
MVAPCPTSMMVRTKKTKAMGVPTIDLSMERSKLSELVVKACEEYGFFKVVNHSVQKEVIARLEEEGKEFFSKTSSEKRQAGPANPFGYGCRNIGPNGDMGHLEYLLLHTNPLSISERSKTIANDPTKFSCAVNDYIEAVKELTCEVLDMVEEGLWVQDKFSLSKLIRDVHSDSLLRINQYPPVSLKGTKNWDTSKLEAHQLQSQNNNNNNNNIGFGEHSDPQILTIMRSNNVDGLQISTHDGLWIPVPPDPNEFFVMVGDALQVLTNGRFVSVRHRVLTNTTKARMSMMYFAAPPLNWWITPLPKMVTPHNPSLYKPFTWAQYKQAAYSLRLGDARLDLFKIQRQQDTHLIAPAST

SEQ ID NO: 492 - DNA, 1002 bp, Glycine max
atggtgttggcttccccaaacccaataaggagcgaagggattctacccagtaacgagcttattcccgttgtggacctcacagcagaaaggtcagaagtggcaaagctcatagtgaaagcgtgcgaagagtacggtttcttcaaggtgataaaccacggtataagccacgaagtgatatcaaaaaccgaagaagcagggtttagtttcttcgaaaaaccggtggcagagaagagagtggcagcacctgcatatgggtgcaagaacatagggttgaatggggacatgggtgaggtggagtaccttgtcctcggtgccaccactcactccattgctcagatatccaaaactgtatccactgacccattaaacttcagctctacattgagtgcatacacagaagcagtgagggagctggcatgtgagatattggaactaatagcagagggcttgggggtcccggacactagggcattcagcaggttcataagggatgttgatagtgactcagttctcaggctcaatcactacccacctataattaacaaggacaaggacaaggacatgtcacaatatagcaaggttggttttggagagcattctgaccctcagatcataaccattctcagatccaacgacgtgggtggcctccaaatttcccttcaagatggggtgtggatcccagttacccctgacccctcagcattctatgtgaacgtgggtgatgtactagaggttatgacaaatggaagatttgtaagcgtgagacacagggctatgacgaactcatacaagtgtagaatgtcagtggcatattttggggctccacccctccatgctaccattgttgctccctcagttatggtcacaccccagaggccctctctctttcgaccattcacttgggccgactacaagaaagccacctactctctcaggcttggagacacacgcattcagcttttcacaaatagactaaccactaatcaccacccaaaagtctag

SEQ ID NO: 493 - protein, 333 aa, Glycine max
MVLASPNPIRSEGILPSNELIPVVDLTAERSEVAKLIVKACEEYGFFKVINHGISHEVISKTEEAGFSFFEKPVAEKRVAAPAYGCKNIGLNGDMGEVEYLVLGATTHSIAQISKTVSTDPLNFSSTLSAYTEAVRELACEILELIAEGLGVPDTRAFSRFIRDVDSDSVLRLNHYPPIINKDKDKDMSQYSKVGFGEHSDPQIITILRSNDVGGLQISLQDGVWIPVTPDPSAFYVNVGDVLEVMTNGRFVSVRHRAMTNSYKCRMSVAYFGAPPLHATIVAPSVMVTPQRPSLFRPFTWADYKKATYSLRLGDTRIQLFTNRLTTNHHPKV

SEQ ID NO: 494 - DNA, 990 bp, Glycine max
atggtgttggcttccccaaactcaataaggagcgaagggattctacccagcaacgagcttattcccgttgtggacctaacagcagaaaggtcacaagtgacaaagctcatagtgaaagcgtgcgaagagtacggtttcttcaaggtgataaaccacggtataagccacgaagtgatatcaaaaactgaagaagcagggtttagtttctttacaaaaccggtggcagagaagaaagtggcagcacctgcatatgggtgcaagaacatagggttgaatggggacatgggtgaggtggagtaccttctcctcagtgccaccactcactccatttctcagatatccaaaactatatccactgacccattaaacgtcagctctacattgagtgcatacacagaagcagtgagggagctcgcatgtgagatattggagctaatagcagaggggttgggggtcccggacacttggatattcagcaggttcataagggatgttgacagtgactcagttctaaggctcaatcactacccacctataattaacaaggacaacaacaaagacatgtcacaaaaatttaccaaggttggctttggagagcattctgatcctcagatcataaccattctcagatccaacgaagtgggtggcctccaaatttcccttcaagatggggtctggatcccagtcacccctgacccctcagcattctatgtgaacgtgggtgatgtactagaggttatgacaaatggaagatttgtaagcgtgagacacagggctatgacgaactcatacaagtgtagaatgtcagtggcatattttggggctccacccctccatgctaccattgttgctccctcagttatggtcacacctcagaggccctctctcttccgaccattcacttgggccgaatacaagaaagcaacttactctctcaggcttggagacacacgcattcaacttttcacaaataaactaaaccactcatga

SEQ ID NO: 495 - protein, 329 aa, Glycine max
MVLASPNSIRSEGILPSNELIPVVDLTAERSQVTKLIVKACEEYGFFKVINHGISHEVISKTEEAGFSFFTKPVAEKKVAAPAYGCKNIGLNGDMGEVEYLLLSATTHSISQISKTISTDPLNVSSTLSAYTEAVRELACEILELIAEGLGVPDTWIFSRFIRDVDSDSVLRLNHYPPIINKDNNKDMSQKFTKVGFGEHSDPQIITILRSNEVGGLQISLQDGVWIPVTPDPSAFYVNVGDVLEVMTNGRFVSVRHRAMTNSYKCRMSVAYFGAPPLHATIVAPSVMVTPQRPSLFRPFTWAEYKKATYSLRLGDTRIQLFTNKLNHS

SEQ ID NO: 496 - DNA, 1032 bp, Glycine max
atggttgtgccttctccttctccaacttctatcaagacaagttacaagaaaaagaagacgataataaaaattccaacgatagacctatccatggaaaggacagagttgtcggaaacagtggtgaaagcctgcgaggaatacggcttcttcaaggttgttaaccacaatgttccgaaggaggttattgcaagaatggaagaagagggtgcagagttttttggcaaagccacctacgagaagcgtggagctggcccagcaagtcctttcggttatggcttcagcaatatcgggcccaacggagatatgggtgacctagagtatcttctgcttcatgctaaccctctttccgtctctgagagatccaaaaccatcgctaatgactccaccaagttcagttgtgttgtgaatgattatgtagaagcagtaaaagaagtaacgtgcgagattttagatctggtggttgagggattaggggtcccagacaagttcgcactaagcaggctcattagagatgtgaatagtgattcagttctgaggatcaatcactaccctccattgaaccagaaggtgaagggcaacaagaatagcattggttttggggcgcattctgaccctcagatcttgaccatcatgcggtccaatgacgtgggtgggcttcaaatttacacccgtgatgggttgtggattcctgtccctcctgaccccaatcaattctttgtcatggtgggtgatgtcttccaggttttgacaaatggaaagttcatgagtgtgaggcacagggcattaaccaacacattgaaggcaaggatgtcaatgatgtactttgcagcaccaccacttgattggtggatcactccgctacccaagatggtgtcaccaccacaaaatccaagtctatataagcccttcacatgggcccagtacaagaaagcaacatattccttacgcctcggagattctcgacttgatctcttcaaggcccagctagatacccatcatgtatctgcctctccatcacaaattcaatgttag

SEQ ID NO: 497 - protein, 343 aa, Glycine max
MVVPSPSPTSIKTSYKKKKTIIKIPTIDLSMERTELSETVVKACEEYGFFKVVNHNVPKEVIARMEEEGAEFFGKATYEKRGAGPASPFGYGFSNIGPNGDMGDLEYLLLHANPLSVSERSKTIANDSTKFSCVVNDYVEAVKEVTCEILDLVVEGLGVPDKFALSRLIRDVNSDSVLRINHYPPLNQKVKGNKNSIGFGAHSDPQILTIMRSNDVGGLQIYTRDGLWIPVPPDPNQFFVMVGDVFQVLTNGKFMSVRHRALTNTLKARMSMMYFAAPPLDWWITPLPKMVSPPQNPSLYKPFTWAQYKKATYSLRLGDSRLDLFKAQLDTHHVSASPSQIQC

SEQ ID NO: 498 - DNA, 1029 bp, Glycine max
atggttgtgctttctccttctccaacttccatcaagacaagctacaagaaaaaaaagacaatgaaaattccaacgatagacctatccatggaaaggacagagttgtcggaaacagtggtgaaagcctgcgaggaatacggtttcttcaaggtgattaaccacaatgttccgaaggaggttattgcaagaatggaagaggagggtgcaaagtttttcgccaaacccacccacgagaagcgtcgagctggcccagcaagtcctttcggttatggcttcaccaatatcgggcccaacggagataagggtgacctagagtatctcttgcttcatgccaaccctctttccgtctctcagagatccaaaaccatcgctagtgactccaccaagttcagttgtgttgtgaatgattatgtagaagcagtgaaagaagtaacgtgtgagattttagatctggtgcttgagggattaggagtcccagagaagtttgcactaagcaagctcattagagatgttaatagtgattgtgttctaaggatcaatcactaccctccattgaaccagaagttgaagggcaacaagaatagcattggttttggggcgcattctgaccctcagatcttgacaatcatgcgttccaatgacgtgggtgggcttcaaatttacacccgtgaagggttgtggattcctatccctcctgaccccaatcaattctttgtcatggtgggcgatgtcttccaggttttgacaaatggaaagttcatgagtgtgaggcacagggcattaaccaacacattgggggcaaggatgtcaatgatgtactttgcagcaccaccacttgattggtggatcactccgctagccaagatggtgtcaccaccacaaaatccaagtctatataagcccttcacatgggaccactacaagaaggcaacatattccttacgcctcggagattctcgacttgatctcttcaaggcccagctagatacccatcatgtatctgtctctccatcacaaattcaatgttaa

SEQ ID NO: 499 - protein, 342 aa, Glycine max
MVVLSPSPTSIKTSYKKKKTMKIPTIDLSMERTELSETVVKACEEYGFFKVINHNVPKEVIARMEEEGAKFFAKPTHEKRRAGPASPFGYGFTNIGPNGDKGDLEYLLLHANPLSVSQRSKTIASDSTKFSCVVNDYVEAVKEVTCEILDLVLEGLGVPEKFALSKLIRDVNSDCVLRINHYPPLNQKLKGNKNSIGFGAHSDPQILTIMRSNDVGGLQIYTREGLWIPIPPDPNQFFVMVGDVFQVLTNGKFMSVRHRALTNTLGARMSMMYFAAPPLDWWITPLAKMVSPPQNPSLYKPFTWDHYKKATYSLRLGDSRLDLFKAQLDTHHVSVSPSQIQC

SEQ ID NO: 500 - DNA, 972 bp, Glycine max
atggtagcacctttcccaatttccactcgaagcgaaaagattttacccattgaccttcccgtggtagacctaaccgcggaaagatcaatggtgacaaaactcattgtgaaggcgtgtgaggaatatggtttcttcaacgtgattaaccatggcattcctcgtgacaccatagctgaaatggaagaaacagcttttgatttctttgccaaaccaatggctcaaaagaaacaacttgccctctatggctgcaagaacataggcttcaatggagacatgggagaggtcgagtaccttctcctcagtgctactcctccctctatttctcacttcaaaaacatctccaatatgccatcaaaattcagctctagtgtgagtgcatacacagagggtgtgagggagctggcatgtgagattttggagctaatggcagagggtctgggggtcccggatacatggtttttcagcaggttgatcagggaggttgatagtgactcagtccttaggttcaatcactacccacctattatacttaacaacaaagattgcaaggacaaccacaaccacaccaaggtaattggctttggggagcattctgaccctcagattcttaccatcctcagatccaacgacgtgggtggcctccaaatctctcttcaagatggtgtgtggaacccagttgcccctgacccctcagctttctgtgttaatgtgggtgatctcttacaggttatgacaaatgggagatttgtgagcgtgagacacagggccatgaccaactcacacaagtctagaatgtcggttgcatattttggtggtccaccacttgatgcatgcattgttgctcccccagttatggttacacccgagaggccctctcttctcttcaagccatttacttgggctgaatacaagaaagtcacctattctatgaggcttggagaacaccgcattgaccttttcaggagcaactag

SEQ ID NO: 501 - protein, 323 aa, Glycine max
MVAPFPISTRSEKILPIDLPVVDLTAERSMVTKLIVKACEEYGFFNVINHGIPRDTIAEMEETAFDFFAKPMAQKKQLALYGCKNIGFNGDMGEVEYLLLSATPPSISHFKNISNMPSKFSSSVSAYTEGVRELACEILELMAEGLGVPDTWFFSRLIREVDSDSVLRFNHYPPIILNNKDCKDNHNHTKVIGFGEHSDPQILTILRSNDVGGLQISLQDGVWNPVAPDPSAFCVNVGDLLQVMTNGRFVSVRHRAMTNSHKSRMSVAYFGGPPLDACIVAPPVMVTPERPSLLFKPFTWAEYKKVTYSMRLGEHRIDLFRSN

SEQ ID NO: 502 - DNA, 1035 bp, Gossypium hirsutum
atgaccaactcagacccacctctccttaaccattatggagcacttttttcaagcaactcacctcaactcgatgaccctaaaaaccgacttgtcattgaagaatgccaacttcctttgattgacttgagtggtctaagcaatcacgacgaaacggttcgccgagcttgtgttgctgccatatgtggggcatcatcagaatggggatttttccaagtgttgaaccatgggattagccctcaactagttgagcaaatgagaagtgaacaagtgaagttgttcaaaataccctttgaaaggaaagctagctgtggacttttgaataattcttacagatggggaagtcctagggctacctgtcctaaacagttctcatggtctgaggctttccatgtccctcttaccaaggtttcagatgaagcttgttatggagagtttatatctttaagggcagtgatgatagaatttgcagctgccatgtcgaaacttgcaggacttctaggaagcattttgacagcgaatttgggacatggaaaggaagtgatcaagaatttatgcgacgaaggcacctgcttccttcgcctgaaccactacccggcctgtccgatatctccggagattttgggtttagtgtgccacaccgatagtgatttcctcacaattctatgtcaagatcaggtaggaggacttcaactcatgaaggactccaagtgggtaactgtcaaacctaaccgagatgctcttatagtcaacattggcgacctcttccaggcatggagcaatggtgtttacaaaagcgtggagcataaggtggtgactaatgcaaagatggagagatactccatagcttatttcctgtgcccctcttacgattcttcgattgggagcttcaaagaaccttcaatctacagaaaatttactttcagggaatatagagaccaagttcaagaagatgtaaggaaaaccggctacaaggttggccttccacggtttctagttagtgggagaggggatttattgacaggaagcatggagtaa

SEQ ID NO: 503 - protein, 344 aa, Gossypium hirsutum
MTNSDPPLLNHYGALFSSNSPQLDDPKNRLVIEECQLPLIDLSGLSNHDETVRRACVAAICGASSEWGFFQVLNHGISPQLVEQMRSEQVKLFKIPFERKASCGLLNNSYRWGSPRATCPKQFSWSEAFHVPLTKVSDEACYGEFISLRAVMIEFAAAMSKLAGLLGSILTANLGHGKEVIKNLCDEGTCFLRLNHYPACPISPEILGLVCHTDSDFLTILCQDQVGGLQLMKDSKWVTVKPNRDALIVNIGDLFQAWSNGVYKSVEHKVVTNAKMERYSIAYFLCPSYDSSIGSFKEPSIYRKFTFREYRDQVQEDVRKTGYKVGLPRFLVSGRGDLLTGSME

SEQ ID NO: 504 - DNA, 1077 bp, Gossypium hirsutum
atgcacctcacctctaggaagtatattttcatttctatagcaatgaccaactcagacccacctctccttaaccattatggagcaattttttcaagccactcacctcaactcgatgtcactaaaaacagacttgtcatcgaagaatgccaacttcctttgattgacttgagtggtctaagcaatcacgacgaaacggttcgccgagcttgtgttgcagccatatgcggcgcatcatcagaatggggatttttccaagtgttgaaccatgggattagccctcaactagttgagaaaatgagaagtgaacaagtgaagttgttcaaaataccctttgaaaggaaagctagttgtggacttttgaataattcttacagatggggaagtccgaggtctacctgtcctaaacagttctcatggtctgaggctttccatatccctcttaccaaggtttcagatgaagcttgttatggagagtttatatctttaagggcagtgatgatagaatttgcagctgccatgtcgaaacttgcaggatttctaggaagcgttttgacagcgaatttgggacatggaaaggaagtgatcaagaatttatgcgacgaaggcacctgcttccttcgcctgaatcactacgcggcctgtccgatatctccggagattttgggtttagtgcgccacatcgatagtgatttcctcacaattctatgtcaagatcaggtaggaggacttcaactcatgaaggactccaagtgggtaactgtcaaacctaaccgagatgctcttatagtcaacattggcgacctcttccaggcatggagcaatggtgtttacaaaagcgtggagcataaggtggtgactaatgcaaagatggagagatactccatagcttatttcctgtgcccctcttacgattcttcgattgggagcttcaaagaaccttcaatctacagaaaatttactttcagggaatatagagaccaagttcaagaagatgtaagaaaaaccggctacaaggttggccttccacggtttctagttagtgggagaggggatttaattacaggaaacatggagtaa

SEQ ID NO: 505 - protein, 358 aa, Gossypium hirsutum
MHLTSRKYIFISIAMTNSDPPLLNHYGAIFSSHSPQLDVTKNRLVIEECQLPLIDLSGLSNHDETVRRACVAAICGASSEWGFFQVLNHGISPQLVEKMRSEQVKLFKIPFERKASCGLLNNSYRWGSPRSTCPKQFSWSEAFHIPLTKVSDEACYGEFISLRAVMIEFAAAMSKLAGFLGSVLTANLGHGKEVIKNLCDEGTCFLRLNHYAACPISPEILGLVRHIDSDFLTILCQDQVGGLQLMKDSKWVTVKPNRDALIVNIGDLFQAWSNGVYKSVEHKVVTNAKMERYSIAYFLCPSYDSSIGSFKEPSIYRKFTFREYRDQVQEDVRKTGYKVGLPRFLVSGRGDLITGNME

SEQ ID NO: 506 - DNA, 1083 bp, Gossypium hirsutum
atggttcattcagattcagacccacctctccttaaccattatggtacacttttatgccactccactcaatgggatgaacctcaaacccgagttaccatggaagaatgccagcttccattgattaacttgtgtgatttaggcagtgacgacgaaatggttcgccgagcttgtgctgccgccatttgcaaagcatcatcggaatggggctttttccaagtggtgaaccatggcattagctctcaactagtcgacaagatgagatgcgagcaagtgaaattattccgagcaccctttgaaacgaaagccaccagtggactgttgaataattcttacaggtggggaagccctagggctacttgtcctaaccaattctcctggtccgaagcttttcatgtccctctcaccaaagtctcgaatgaagcttgctatggagacttcaaatctttaagggaagtgatgacatgttttgcagcagccatgtcggagctgtcgaggcttctagcagggatcctgactgaaaatctgggcaactggaaacaagcatcgatcagcaacatatgcgacgaaacaacatgtttccttcgcctgaatcactacccagcatgtccaatatctccggagattttcggtttagtgcctcacaccgacagcgatttcctaacgattctttgccaagatcaagttggagggcttcaactcatgaaagactccaaatgggtgaccgtcaaacctaacaaagatgctcttatagtcaacattggggaccttttccaggcatggagcaatgatgtttacaaaagcgtggaacacaaggtggtttccaatgcaacaacggacagatactccatagcttatttcctttgcccttcttacgattctttgatcgagagcttcgtaaaaccttccatttacagaagatttactttcagggaatacagagaacaagttcaagaagatgtcagaaaaacagggtacaaggttggccttcccaggtttctacttaagggctccgaggacttaacaacaacaacaacagagtcaaatactagactatatattccaagcataacagccaagagctaa

SEQ ID NO: 507 - protein, 360 aa, Gossypium hirsutum
MVHSDSDPPLLNHYGTLLCHSTQWDEPQTRVTMEECQLPLINLCDLGSDDEMVRRACAAAICKASSEWGFFQVVNHGISSQLVDKMRCEQVKLFRAPFETKATSGLLNNSYRWGSPRATCPNQFSWSEAFHVPLTKVSNEACYGDFKSLREVMTCFAAAMSELSRLLAGILTENLGNWKQASISNICDETTCFLRLNHYPACPISPEIFGLVPHTDSDFLTILCQDQVGGLQLMKDSKWVTVKPNKDALIVNIGDLFQAWSNDVYKSVEHKVVSNATTDRYSIAYFLCPSYDSLIESFVKPSIYRRFTFREYREQVQEDVRKTGYKVGLPRFLLKGSEDLTTTTTESNTRLYIPSITAKS

SEQ ID NO: 508 - DNA, 1086 bp, Gossypium hirsutum
atggttcattcagattcagacccacctctccttaaccattatggtacacttttatgccactccactcaatgtgatgaacctcaaacccgagttaccatggaagaatgccagcttccattgattgacttgtgtgatttaggcagtgacgacgaaatggttcgccgagcttgtgctgccgccatttgcaaagcatcatcggaatggggctttttccaagtggtgaaccatggcattagctctcaactagtcgacaagatgagaagcgagcaagtgaaattattccgagcaccctttgaaacgaaagccaccagtggactgttgaataattcttacaggtggggaagccctagggctacttgtcctaaccaattctcctggtccgaagcttatcatgtccctctcaccaaagtctcagatgaagcttgctatggagacttcaaatctttaagggaagtgatgacatgttttgcagcagctatgtcggaactgtcgaggcttctagcagggatcctgactgaaaatctgggccactggaaacaagcatcgatcagcaacatatgcgacgaaacatgtttccttcgcctgaatcactacccagcatgtccaatatctccggagattttcggtttagtgccccacaccgacagcgatttcctaacgattctttgccaagatcaagttggagggcttcaactcatgaaagactccaaatgggtgactgtcaaacctaacaaagatgctcttatagtcaacattggggaccttttccaggcatggagcaatgatgtttacaaaagcgtggaacacaaggtggtttccaatgcaacaacggacagatactccatagcttatttcctttgcccttcttacgattctttgatcgagagcttcgtaaaaccttccatttacagaagatttactttcagggaatacagagaacaagttcaagaagatgtcagaaaaacagggtacaaggttggccttcccaggtttctacttaaaggctccgaggatttaacaacaacaacaacaacaacagagtcaaataccagactatacattccaagcataacagccaagagctaa

SEQ ID NO: 509 - protein, 361 aa, Gossypium hirsutum
MVHSDSDPPLLNHYGTLLCHSTQCDEPQTRVTMEECQLPLIDLCDLGSDDEMVRRACAAAICKASSEWGFFQVVNHGISSQLVDKMRSEQVKLFRAPFETKATSGLLNNSYRWGSPRATCPNQFSWSEAYHVPLTKVSDEACYGDFKSLREVMTCFAAAMSELSRLLAGILTENLGHWKQASISNICDETCFLRLNHYPACPISPEIFGLVPHTDSDFLTILCQDQVGGLQLMKDSKWVTVKPNKDALIVNIGDLFQAWSNDVYKSVEHKVVSNATTDRYSIAYFLCPSYDSLIESFVKPSIYRRFTFREYREQVQEDVRKTGYKVGLPRFLLKGSEDLTTTTTTTESNTRLYIPSITAKS

SEQ ID NO: 510 - DNA, 1020 bp, Gossypium hirsutum
atggttgtgcattcacagtctgcagcattagaccattgctctttgatcaaaacatgcaagcctaccaccagtgttttcaaaggaatcccagtggtagacttgcgggaccctgaagcaaagaccctcatagttaaggcttgtgaggaatatggcttctttaagctagtcaatcatggtgttccaatggaattcttcactagattagaagctgaagctctcaagttcttcaatctcccccagtctgacaaagacaaagccggccctcctgatccttttggctatggtgtcaagaaaattggctctaatggcgatgtgggatgggttgaatacctcctccttaacaccaatcctcaaatcacttccctcaaatccctcactgttttccgagaaacccctgaaatttttcgctctgcggtgaacgactatatccaagcagtgaagagaatgacatttgaagtggtggaattaatggcggatggtctgaaaatagagccgagggatgcgttgagtaggctattgagagacgagaagagtgactcgtgtttcaggctaaaccactatccaccatgcccggagctacaagcattgggtggtagaaacctgatagggttcggggagcatacagacccgcagataatatctgtcctaagatcaaacaacacatctggcctgcaaatctgtctcagagataagacttgggtttcagtcccacctgatcagacctccttttttatcaatgttggtgatgccttgcaggtaatgacaaatgggagattaagaagtgtgaggcacagagtgttggcagaatcaatgagatcaagggtatcaatgatctattttggagggccacctttaagtgaaaagatagtacccttagcttcattaatggcgaaaggagaagagagcttgtacgaggagttcacatggtgggaatacaagacttctgcatacaaatcaaggttgggtgattataggctaggcctctttgagaaaaaaactggtggtgctgcaggccaatga

SEQ ID NO: 511 - protein, 339 aa, Gossypium hirsutum
MVVHSQSAALDHCSLIKTCKPTTSVFKGIPVVDLRDPEAKTLIVKACEEYGFFKLVNHGVPMEFFTRLEAEALKFFNLPQSDKDKAGPPDPFGYGVKKIGSNGDVGWVEYLLLNTNPQITSLKSLTVFRETPEIFRSAVNDYIQAVKRMTFEVVELMADGLKIEPRDALSRLLRDEKSDSCFRLNHYPPCPELQALGGRNLIGFGEHTDPQIISVLRSNNTSGLQICLRDKTWVSVPPDQTSFFINVGDALQVMTNGRLRSVRHRVLAESMRSRVSMIYFGGPPLSEKIVPLASLMAKGEESLYEEFTWWEYKTSAYKSRLGDYRLGLFEKKTGGAAGQ

SEQ ID NO: 512 - DNA, 996 bp, Gossypium hirsutum
atggtggtggtgtcaaaaccagcaattgaacagttctcttcttacctgaaaaacaacaaaccaaccacattgttcactcaaatcccacttgtagacctctcaaaacctgattcaaaacaccaaataatcaaagcctgtgaagagtttgggttcttcaaggtgatcaaccatggggttccaatggaatccatttccatgttggaatccgaagctaccaagttcttcagtttaccactttgtgagaaacaaaaaacaggacaacctcaaccttatggttatggtcataaaaggattggtatgcacggtgatgttggttgggttgagtatcttcttttgactactaatcaagaccccagtctccatagcttccaaactttcagggtggctttgaatagctatatgaaatcagtaaagaaaatggcatgtgagatacttgaaatgatggctgatgggttgaagatacaacccaggaatgtgctgagcaaactgttgatggatgaagagagtgactctgttttcagggtgaatcattacccaccatgccctaatgttcaacctttgaatggtaatggcaatggcaatggggatgtgattggatttggtgaacacactgacccacaaattatctcagtgttgagatctaacaacacttctggtcttcaaatctctctaagagaaggaagctggatttcagtgccacctgaccaaacctcattcttcatcaatgttggtgactccttacaggtaatgaccaatggaaggtttaaaagtgtaaaacatagggtagtgaccaacagtgtgaaatcaaggctatcaatgatttatttttgtggaccaccattgagtgagaaaatagcacctttgccatctttgatgagaggtgatcaacaaagcttatataaagaatttacttggttcgagtacaaaaaatctgcttataattccagattggcagataataggctcattcactttgaaaaaattgctgcttcttaa

SEQ ID NO: 513 - protein, 331 aa, Gossypium hirsutum
MVVVSKPAIEQFSSYLKNNKPTTLFTQIPLVDLSKPDSKHQIIKACEEFGFFKVINHGVPMESISMLESEATKFFSLPLCEKQKTGQPQPYGYGHKRIGMHGDVGWVEYLLLTTNQDPSLHSFQTFRVALNSYMKSVKKMACEILEMMADGLKIQPRNVLSKLLMDEESDSVFRVNHYPPCPNVQPLNGNGNGNGDVIGFGEHTDPQIISVLRSNNTSGLQISLREGSWISVPPDQTSFFINVGDSLQVMTNGRFKSVKHRVVTNSVKSRLSMIYFCGPPLSEKIAPLPSLMRGDQQSLYKEFTWFEYKKSAYNSRLADNRLIHFEKIAAS

SEQ ID NO: 514 - DNA, 1164 bp, Gossypium hirsutum
atgcacttcgctatctgctcttcccatttttcgtatttaaataccaccaatttcccccccttcattacccttctcttcaatctgtctctgtttcccttattttcctctgctttctttcctcctttcaaaagaaaagaagaaaccatggttgtgcattcacagtctgcagcattagaccattgctctttgatcaaaacatgcaagcctaccaccagtgttttcaaaggaatccctgtggtagacttgagggaccctgaagcaaagaacctcatagttaaggcttgtgaggaatatggcttctttaagctagtcaatcatggtgttccaatggaattcttcaccagattagaagctgaagctctcaagttcttcaatctcccccagtctgacaaagacaaagccggccttcctgatccttttggctatggtttcaagaaaattggctctaatggcgatgtgggatgggttgaatacctcctccttaacaccaatcctcaaatcacttccctcaaatccctcactgttttccgagaaacccctgaaatttttcgctctgctgtgaacgactatatccaagcagtgaagagaatgacatttgaagtggtggaattactggcggatggtctgaaaatagagccgagggatgcgttaagtaggctattgagagacgagaagagtgactcgtgtttcaggctaaaccactatccaccatgcccggagctacaagcattgggtggtagaaacctgatagggttcggggagcatacagacccgcaaataatatctgtcctaagatcaaacaacacatctggcctgcaaatctgtctcagagataagacttgggtttcagtcccacctgatcagacctccttttttatcaatgttggtgatgccttgcaggtaatgacaaatgggagattaagaagtgtgaggcacagagtgttggcagaatcaatgagatcaagggtatcaatgatctattttggagggccacctttaagtgaaaagatagcacctttagcttcattaatggcgaaaggagaagagagcttgtacgaggagttcacatggtgggaatacaagacttctgcatacaaatcaaggttgggtgattataggctaggcctctttgagaaaaaaactggtggtgctgcaggccaatga

SEQ ID NO: 515 - protein, 387 aa, Gossypium hirsutum
MHFAICSSHFSYLNTTNFPPFITLLFNLSLFPLFSSAFFPPFKRKEETMVVHSQSAALDHCSLIKTCKPTTSVFKGIPVVDLRDPEAKNLIVKACEEYGFFKLVNHGVPMEFFTRLEAEALKFFNLPQSDKDKAGLPDPFGYGFKKIGSNGDVGWVEYLLLNTNPQITSLKSLTVFRETPEIFRSAVNDYIQAVKRMTFEVVELLADGLKIEPRDALSRLLRDEKSDSCFRLNHYPPCPELQALGGRNLIGFGEHTDPQIISVLRSNNTSGLQICLRDKTWVSVPPDQTSFFINVGDALQVMTNGRLRSVRHRVLAESMRSRVSMIYFGGPPLSEKIAPLASLMAKGEESLYEEFTWWEYKTSAYKSRLGDYRLGLFEKKTGGAAGQ

SEQ ID NO: 516 - DNA, 1035 bp, Gossypium hirsutum; identical to SEQ ID NO: 502

SEQ ID NO: 517 - protein, 344 aa, Gossypium hirsutum; identical to SEQ ID NO: 503

SEQ ID NO: 518 - DNA, 996 bp, Gossypium hirsutum
atggtggtggtgtcaaaaccagcaattgaacagttctcttcttacctgaaaaacaacaaaccaaccacattgttcactcaaatcccacttgtagacctctcaaaacctgattcaaaacaccaaataatcaaagcttgtgaagagtttgggttcttcaaggtgatcaaccatggggttccaatggaatccatttccgtgttggaatccgaagctaccaagttcttcagtttaccactttgtgagaaacaaaaaacaggacaaactcaaccttatggctatggtcataaaaggattggtacacaaggtgatgttggttgggttgagtatcttcttttgactactaatcaagaccccagtctccatagcttccaaactttgagggtggctttgaataattatatgaaatcagtaaagaaaatggcgtgtgagatacttgaaatgatggctgatgggttgaagatacaacccaggaatgtgttgagcaagctgttgatggatgaagagagtgactctgttttcagggtgaatcattacccaccatgccctaatgttcaacctttgagtggtaatggcaatggcaatggggatgtgattggatttggtgaacacactgatccacaaattatctcagtgttgagatctaacaacacttctggtcttcaaatctctctaagagaaggaagctggatttcagtgccacctgaccaaacctcattcttcatcaatgttggtgactccttacaggtaatgaccaatggaaggtttaaaagtgtaaaacatagggtagtgaccaacagtgtgaaatcaaggctatcaatgatttattttggtggaccaccattgagtgagaaaatagcacctttgccatctttgatgagaggtgatcaacaaagcttatataaagaatttacttggttcgagtacaagaaatctgcttataattccagattggcagataataggctcattcactttgaaaaaattgctgcttcttaa

SEQ ID NO: 519 - protein, 331 aa, Gossypium hirsutum
MVVVSKPAIEQFSSYLKNNKPTTLFTQIPLVDLSKPDSKHQIIKACEEFGFFKVINHGVPMESISVLESEATKFFSLPLCEKQKTGQTQPYGYGHKRIGTQGDVGWVEYLLLTTNQDPSLHSFQTLRVALNNYMKSVKKMACEILEMMADGLKIQPRNVLSKLLMDEESDSVFRVNHYPPCPNVQPLSGNGNGNGDVIGFGEHTDPQIISVLRSNNTSGLQISLREGSWISVPPDQTSFFINVGDSLQVMTNGRFKSVKHRVVTNSVKSRLSMIYFGGPPLSEKIAPLPSLMRGDQQSLYKEFTWFEYKKSAYNSRLADNRLIHFEKIAAS

SEQ ID NO: 520 - DNA, 1077 bp, Gossypium hirsutum; identical to SEQ ID NO: 504

SEQ ID NO: 521 - protein, 358 aa, Gossypium hirsutum; identical to SEQ ID NO: 505

SEQ ID NO: 522 - DNA, 999 bp, Gossypium hirsutum
atggtgatactgtcaaaaccagcaattgaacagtttagttgtatcagaaacaagcaggcagctacattgttccctcctcttatccctcttgtggacctctccaaaccagattccaggcagcagatcatcaaagcctgtgaagaatttgggttcttcaaggtcatcaaccatggggttcccatggacttcatttcccggctagaatctgaagccaccaagttcttctctttacccctttctgagaaagagaaaacaggacaacccaagccttatggctatggtaataaaaggattggaccaaatggtgatgttggttgggtggaatatcttctcctcacaaccaaccaagacccgaatctccttggaactgaaaacccagagagtttcaggattgctttggataattatatggcagcagtgaagaaaatggcatgtgagatacttgaaatgatagctgatgggctaaagattcagccaagaaatgtgttgagtaagctgatgatggatgaacagagtgactctgttttcaggctgaaccattaccctccatgcccagaggtggttcagtccttgaatggaacgagcagtaatgtgattggattcggtgaacacactgacccacaaatcatttcggtcctaagatccaacaacacttccggccttcaaatctctcttagagatggcacttggatttcagtcccaccagaccaatactcttttttcatcaatgttggtgattccttacaggtgatgacaaatggaaggtttaaaagtgtgaagcatagggtactggccaacagtgtgaaatcaaggctttcaatgatttatttttgtggaccacctttgagtgagaaaatagctccattgccatctttgatgagaggggatcaacaaagcttgtacaaagaatttacatggtttgagtacaaaaaatctgcttacagttctagattggcagataacaggctcatgcacttcgaaaaaatagttgcctcataa

SEQ ID NO: 523 - protein, 332 aa, Gossypium hirsutum
MVILSKPAIEQFSCIRNKQAATLFPPLIPLVDLSKPDSRQQIIKACEEFGFFKVINHGVPMDFISRLESEATKFFSLPLSEKEKTGQPKPYGYGNKRIGPNGDVGWVEYLLLTTNQDPNLLGTENPESFRIALDNYMAAVKKMACEILEMIADGLKIQPRNVLSKLMMDEQSDSVFRLNHYPPCPEVVQSLNGTSSNVIGFGEHTDPQIISVLRSNNTSGLQISLRDGTWISVPPDQYSFFINVGDSLQVMTNGRFKSVKHRVLANSVKSRLSMIYFCGPPLSEKIAPLPSLMRGDQQSLYKEFTWFEYKKSAYSSRLADNRLMHFEKIVAS

SEQ ID NO: 524 - DNA, 999 bp, Gossypium hirsutum
atggtgatactgtcaaaaccagcaattgaacagtttggttgtatcagaaacaagcaggcagctacattgttccctccgcttatccctcttgtggacctctccaaaccagattccaggcagcagatcatcaaagcctgcgaagaatttgggttcttcaaggtgatcaaccatggtgttcccatggacttcatttcccggctggaatctgaagccaccaagttcttctctttacccctttcggagaaagagaaaacaggacaaccccagccttatggctatggtaataaaaggattggaccaaatggtgatgttggttgggtggaatatcttctcctcacaaccaaccaagacccgaatctccttggaactgaaaacccagagagtttcaggattgctttggataattatatggcagcagtgaagaaaatggcatgtgagatacttgaaatgatagctgatgggctaaaggttcagccaagaaatgtgttaagtaagctgatgatggatgaacagagtgactctgttttcaggctgaaccattaccctccgtgcccagaggtggttcagtccttgaatggaacgagcagtaatgtgattggattcggtgaacacactgacccacaaatcatttcagtcctaagatccaacaacacttccggccttcaaatctctcttagagatggcacttggatttcagtcccaccagaccaatactcttttttcatcaatgttggtgattccttacaggtgatgacaaatggaaggtttaaaagtgtgaagcacagggtactggccaacagtgtgaaatcaaggctttcaatgatttatttttgtggaccacctttgagtgagaaaatagctccattgccatctttgatgagaggggatcaacaaagcttgtacaaagaatttacatggtttgagtacaaaaaatctgcttacagttctagattggcagataacaggctcatgcacttcgaaaaaatagttgcctcataa

SEQ ID NO: 525 - protein, 332 aa, Gossypium hirsutum
MVILSKPAIEQFGCIRNKQAATLFPPLIPLVDLSKPDSRQQIIKACEEFGFFKVINHGVPMDFISRLESEATKFFSLPLSEKEKTGQPQPYGYGNKRIGPNGDVGWVEYLLLTTNQDPNLLGTENPESFRIALDNYMAAVKKMACEILEMIADGLKVQPRNVLSKLMMDEQSDSVFRLNHYPPCPEVVQSLNGTSSNVIGFGEHTDPQIISVLRSNNTSGLQISLRDGTWISVPPDQYSFFINVGDSLQVMTNGRFKSVKHRVLANSVKSRLSMIYFCGPPLSEKIAPLPSLMRGDQQSLYKEFTWFEYKKSAYSSRLADNRLMHFEKIVAS

SEQ ID NO: 526 - DNA, 984 bp, Gossypium hirsutum
atggttgtgttgtcacagccaccagcattagagcattgttccttgatcaaaacatgcaagcctacatgtgttttctcagggattccggtgattgaactaagggacccggaagcaaagaccctcatagtcaaggcctgtgaagagtatggcttcttcaaactgatcaatcatggtgttccaatggaattcatgaccagattggaagctgaagctcttagcttctttaacctcccccagtccgacaaggacaaagctaccccttttggctatggcagcaacaaaattggaccaaatggtgacgtgggatggattgaatatctccttgtcaataccaatcctcaactcacctccctcaaaactctttcagaaaatttctgctatgcagtgaatgactatattctagcagtgaagagattggcatttgaagtagtggaaataatggccgatggcctggaaattgagccaaggaatgtgttgagtaggttattaagagatgagaagagtgactcgtgtttcaggctaaaccactatccaccatgcccacagctacaggcattgagtggtagaaatttaattgggtttggggaacatacagacccacagataatttctatcctaagatccaacaacacatcaggcctgcaaatatgtctgagagataggacttgggtttcagtccctcctgatcaaacctcctttttcatcagtgttggtgatgccttgcaggtaatgagtaatgggaggctaagaagtgtaaggcatagggtgttaacagactcaatgaaatcaagggtttcaatgatctattttggagggccacctatgagtgaaaagatagtggctttaccttgtctaatggcaaagggagaagagagcttgtacaaggaattcacatggtgggaatacaaaacttgtgcatacaattcaaggttgggtgctaataggcttgggctgtttgagaaaactgctaatgcaagcctatga

SEQ ID NO: 527 - protein, 327 aa, Gossypium hirsutum
MVVLSQPPALEHCSLIKTCKPTCVFSGIPVIELRDPEAKTLIVKACEEYGFFKLINHGVPMEFMTRLEAEALSFFNLPQSDKDKATPFGYGSNKIGPNGDVGWIEYLLVNTNPQLTSLKTLSENFCYAVNDYILAVKRLAFEVVEIMADGLEIEPRNVLSRLLRDEKSDSCFRLNHYPPCPQLQALSGRNLIGFGEHTDPQIISILRSNNTSGLQICLRDRTWVSVPPDQTSFFISVGDALQVMSNGRLRSVRHRVLTDSMKSRVSMIYFGGPPMSEKIVALPCLMAKGEESLYKEFTWWEYKTCAYNSRLGANRLGLFEKTANASL

SEQ ID NO: 528 - DNA, 996 bp, Gossypium hirsutum; identical to SEQ ID NO: 512

SEQ ID NO: 529 - protein, 331 aa, Gossypium hirsutum; identical to SEQ ID NO: 513

SEQ ID NO: 530 - DNA, 1020 bp, Gossypium hirsutum
atggtggttcaatccaatctttcgacgttgaaccattgttcatcgatcgaaacacgtaaacccgccaccgttctcgactccataccgtcgataaacttgaaagacctcgaatcgaaaactcacataatgaaagcttgtgaagaatatgggttcttcaaggtggtgaatcacagtgttccaatggagtttatagctaaattggaagctcaagctttggagttttttaatcttcctcaatccgaaaaagataaagctggtccaccagatccttttggttatggtagcaaaaggattggaagcaatggtgatgttggttggattgaatatcttcttctcaataccaatcctcaagtcacttctcttaaaaccctcactgttttccgggaaaccccagaaattttctggtcagctgtaaaggagtatattgaagcagtgaagctaatggcatgtgaagtattggaactaatagcagatggtctgaaaattgaaccaagggatacattgagcaagctgttaaaggatgagaatagtgattcatgctttaggctaaaccattatccaccatgccctgaattacaggcattgagtggcagagatttggttgggtttggggaacacactgaccctcaaataatctctgtcttaagatccaacagcacatctggtttgcaaatttgtctgaaagatggggtttgggtttctgtcccacctgatgaaacttcctttttcatcaacgttggtgatgctttgcaggtgatgacaaatgggaggttcaaaagtgtgaggcatagagtattggcaaattcacacaaatcaagggtttcaatgatatattttggaggaccacctttaagtgaaaagatagtacctttaacttcactaatgggaaaacaagaagaaagcttatacaaagagttcacatggtgggaatacaagacttcagcatataagtcaaggttggctgactataggcttgggttgtttgagaaaaaaacacaccaagtgcaagccattgaatga

SEQ ID NO: 531 - protein, 339 aa, Gossypium hirsutum
MVVQSNLSTLNHCSSIETRKPATVLDSIPSINLKDLESKTHIMKACEEYGFFKVVNHSVPMEFIAKLEAQALEFFNLPQSEKDKAGPPDPFGYGSKRIGSNGDVGWIEYLLLNTNPQVTSLKTLTVFRETPEIFWSAVKEYIEAVKLMACEVLELIADGLKIEPRDTLSKLLKDENSDSCFRLNHYPPCPELQALSGRDLVGFGEHTDPQIISVLRSNSTSGLQICLKDGVWVSVPPDETSFFINVGDALQVMTNGRFKSVRHRVLANSHKSRVSMIYFGGPPLSEKIVPLTSLMGKQEESLYKEFTWWEYKTSAYKSRLADYRLGLFEKKTHQVQAIE

SEQ ID NO: 532 - DNA, 744 bp, Brassica napus
atggtggttctatcacagcacgttgctttagataaccacttatccgtaatcccaacatacaaaccggttccggtccccgtcgtggacctaaccgacccagaagccaaaactctaatcgtgaaagcctgtgaagagtttggtttcttcaaggttgtaaaccacggagtccgaccagacctcatgacccggttagagcaggaggctgtcggcttcttcgccttgccacagtctcttaaaaaccaggccggtccgcctgaaccctacggttatggtagtaaacggattggaccaaacggggacgtgggatggatagagtatatcctcctcaatgctaaccctcagctcacgtctcccaaaacctccgccattttccgtcaaaccccacaaattttccgagaggcggtggaggagtacatgaaggaggtgaagaaagtcacgtgcaaagtgttggagatggtgacggaaggattaggaatagagccaagggacacactgagtaagatggtgagagatgagaagagtgactcttgcttgagaatgaaccattatcctacggcggaggaagaggtggagaagatggtgaaagtagggtttggggaacacacagacccacaaatcatctcagtgctacggtccaataacactgcgggtcttcaaatctgtatgaaagatggaagttgggtcgctgtccctcctgatcactcttctttcttcatcaatgttggagatgctcttcagatttga

SEQ ID NO: 533 - protein, 247 aa, Brassica napus
MVVLSQHVALDNHLSVIPTYKPVPVPVVDLTDPEAKTLIVKACEEFGFFKVVNHGVRPDLMTRLEQEAVGFFALPQSLKNQAGPPEPYGYGSKRIGPNGDVGWIEYILLNANPQLTSPKTSAIFRQTPQIFREAVEEYMKEVKKVTCKVLEMVTEGLGIEPRDTLSKMVRDEKSDSCLRMNHYPTAEEEVEKMVKVGFGEHTDPQIISVLRSNNTAGLQICMKDGSWVAVPPDHSSFFINVGDALQI

SEQ ID NO: 534 - DNA, 744 bp, Brassica napus
atggtggttttatcacagcacgttgctttagataaccacttatccgtaatcccaacatacaaaccggttccggtccccgtcgtggacctaaccgacccagaagccaaaactctaatcgtgaaagcctgtgaagagtttggtttcttcaaggttgtaaaccacggagtccgaccagacctcatgacccggttagagcaggaggctgtcggcttcttcgccttgccacagtctcttaaaaaccaggccggtccgcctgaaccgtacggttatggtagtaaacggattggaccaaacggggacgtgggatggatagagtatattctcctcaatgctaatcctcagctcacgtctcccaaaacctccgccattttccgtcaaaccccacaaattttccgagaggcggtggaggagtacatgaaggaggtgaagaaagtcacgtgcaaagtgttggagatggtgacggaaggattagggatagagccaagggacacactgagtaagatggtgagagatgagaagagcgactcttgcttgagaatgaaccattatcctacggcggaggaagaggtggagaagatggtgaaagtaggatttggggaacacacagacccacaaatcatctcagtgctacggtccaataacactgcgggtcttcaaatctgtatgaaagatggaagttgggtcgctgtccctcctgatcactcttctttcttcatcaatgttggagatgctcttcagatttga

SEQ ID NO: 535 - protein, 247 aa, Brassica napus; identical to SEQ ID NO: 533

SEQ ID NO: 536 - DNA, 792 bp, Brassica napus
atggtggttttatcacagccagtcgccttagacaaccacatatccgtaatcccaacgtacaccccggttccggtcttcacttcccaaccaatccccgtcgtggacctaaccgacccagaagccaaaaccctaatcgtgaaagcttgtgaggagtttggttttttcaaggttgtaaaccacggagtccgagatgacctcatgacccggttagagcaggaggctatccgctttttcgccttgccccagtctcttaagaaccaggccggtccacctgaaccgtacggatatggtagtaaacggattggaccaaacggtgacgttgggtggattgagtatatcctcctcaatgctaaccctcagctctccaccccaaatacatctgacgttttcggtcaaaccccacagatttttcgagaggcggtggacgagtacatgcacgagttgaaggaagtgtcgtgcaaggttttggagatggtgacggaaggattagggatagagccaagggacacactgagtaagatggtgagagatgagaagagtgactcttgcttgagactgaaccattatccgacggcggaggaagaggcggagaacatggtgaaagtagggtttggggaacacacagacccacaaataatctcagtgctaaggtccaatgacacggcgggtcttcaaatatgtatgaaagatggaagttgggtcgctgtccctcctgatcactcctcttttttcattaatgttggagatgctcttcagtttactggtggtctaaactcaaaagtattttcttaa

SEQ ID NO: 537 - protein, 263 aa, Brassica napus
MVVLSQPVALDNHISVIPTYTPVPVFTSQPIPVVDLTDPEAKTLIVKACEEFGFFKVVNHGVRDDLMTRLEQEAIRFFALPQSLKNQAGPPEPYGYGSKRIGPNGDVGWIEYILLNANPQLSTPNTSDVFGQTPQIFREAVDEYMHELKEVSCKVLEMVTEGLGIEPRDTLSKMVRDEKSDSCLRLNHYPTAEEEAENMVKVGFGEHTDPQIISVLRSNDTAGLQICMKDGSWVAVPPDHSSFFINVGDALQFTGGLNSKVFS

SEQ ID NO: 538 - DNA, 795 bp, Brassica napus
atggtggttttatcacagccagtcgccttagacaaccacatatccgtaatcccaacgtacaccccggttccggtcttcacttcccaaccaatccccgtcgtggacctaaccgacccagaagccaaaaccctaatcgtgaaagcttgtgaggagtttggttttttcaaggttgtaaaccacggagtccgagctgacctcatgacccggttagagcaggaggctatccgcttcttcgccttgccccagtctcttaagaaccaggccggtccacctgaaccgtacggatatggtagtaaacggattggaccaaacggtgacgttgggtggattgagtatatcctcctcaatgctaaccctcagctctccacccctaaaacatccgacgttttcggtcaaaccccacaaatttttcgagaggcggtggacgagtacatgcacgagttgaaggaagtgtcgtgcaaggttttggggatggtgacggaaggattagggatagagccaagggacacactgagtaagatggtgagagatgagaagagtgactcttgcttgagactgaaccattatccgacggcggaggaagaggcggagaacatggtgaaagtagggtttggggaacacacagacccacaaataatctcagtgctaaggtccaatgacacggcgggtcttcaaatatgtatgaaagatggaagttgttgggttgctgtccctcctgatcactcctcttttttcattattgttggagatgctcttcagtttactggtggtctaaactcaaaagtattttcttaa

SEQ ID NO: 539 - protein, 264 aa, Brassica napus
MVVLSQPVALDNHISVIPTYTPVPVFTSQPIPVVDLTDPEAKTLIVKACEEFGFFKVVNHGVRADLMTRLEQEAIRFFALPQSLKNQAGPPEPYGYGSKRIGPNGDVGWIEYILLNANPQLSTPKTSDVFGQTPQIFREAVDEYMHELKEVSCKVLGMVTEGLGIEPRDTLSKMVRDEKSDSCLRLNHYPTAEEEAENMVKVGFGEHTDPQIISVLRSNDTAGLQICMKDGSCWVAVPPDHSSFFIIVGDALQFTGGLNSKVFS

SEQ ID NO: 540 - DNA, 753 bp, Brassica napus
atggtgaaagggtcccagaaaatcgtggccgcagataaaggcataccaataatagacatgtcgcaggagagatcacgagtgtcgatgcagatagtcaaagcctgcgagactctcggctttttcaaggtggtcaaccacggctttgaccgaaccatcatctcaaggatggagcaagagtccattaacttcttcgctaaatcggttcacgaaaagaaatcggttgaatcggttaaccagccatttcgttatggctttagggacatcggtctcaacggtgactctggtgaggtcgagtacttgctgtttcataccaacgaccccgcttttcgctctaagccatccttccgagtctcagtctgtctcagtattcactcggcagtgaattgttacatagaagcagttaggcagttggctcatgagatattagaactgacggctgagggacttggggtcccacctcacaccttcagtaggttgatcagctccgtcgatagtgactccattttgagggtgaatcactatccaccgtccgatcagtttttcggtggagccacacactctgataaatctgtgtcactgaccagggttggcttcggagaacacaccgacccgcagatcttaacagttcttcgatctaacggtgtaggaggcctccaagtgtccaacccagacggcatgtgggtccctgtcttccctgacccctcagctttctgcgtcaatgtaggagacttgttgcaggtcggtgtcttttaa

SEQ ID NO: 541 - protein, 250 aa, Brassica napus
MVKGSQKIVAADKGIPIIDMSQERSRVSMQIVKACETLGFFKVVNHGFDRTIISRMEQESINFFAKSVHEKKSVESVNQPFRYGFRDIGLNGDSGEVEYLLFHTNDPAFRSKPSFRVSVCLSIHSAVNCYIEAVRQLAHEILELTAEGLGVPPHTFSRLISSVDSDSILRVNHYPPSDQFFGGATHSDKSVSLTRVGFGEHTDPQILTVLRSNGVGGLQVSNPDGMWVPVFPDPSAFCVNVGDLLQVGVF

SEQ ID NO: 542 - DNA, 885 bp, Brassica napus
atggtggttttatcacggccagtcgctttagataatcacatatcagtaatcccagcatacaagccagctccggttctcacatcccattcaatccccgtcgtggacctaacccacccagaagccaaaacccttatcgtgaaagcttgtgaggagtttggtttcttcaaggttgtcaaccacggagtgtgccctgacctcatgacccggttagagcaggaagctgtcggcttcttcgccttgcctcagtctctcaaaaaccaggccggtccacctgaaccgtacggttatggtagtaaacggattggaccaaacggtgacgtggggtggattgagtatatcctcctcaatgctaaccctgagctctcgtcacccaaaacctctgccgttttcagtcaaagcccactaattttccgagtttcagcgatattcaatgtttctagaaacaagtgcgaaagtgacaaatcattggaccaccgaaaagatttcaagactgagttacctgaggcagtggaggaatacatgaaagaggtgaaggaagtgtcgtgcaaagtgttggagatgataactgaaggattggggatagagccaagggacagtctgagtaagatggtgagagatgagaagagtgactcgtgcctgagactgaaccactatccgacggcggaggaagaggcggagaagatggtgaagttagggtttggggaacacacagacccacagatcatctcagtgctaaggtccaataacgcagcgggtcttcaaatctgtatgaaagatggaagctgggtcgctgtccctcctgatcactcttctttcttcattaatgttggagatgctcttcagtttaaccgggctggtcaaaactcattaaagtattttcagtag

SEQ ID NO: 543 - protein, 294 aa, Brassica napus
MVVLSRPVALDNHISVIPAYKPAPVLTSHSIPVVDLTHPEAKTLIVKACEEFGFFKVVNHGVCPDLMTRLEQEAVGFFALPQSLKNQAGPPEPYGYGSKRIGPNGDVGWIEYILLNANPELSSPKTSAVFSQSPLIFRVSAIFNVSRNKCESDKSLDHRKDFKTELPEAVEEYMKEVKEVSCKVLEMITEGLGIEPRDSLSKMVRDEKSDSCLRLNHYPTAEEEAEKMVKLGFGEHTDPQIISVLRSNNAAGLQICMKDGSWVAVPPDHSSFFINVGDALQFNRAGQNSLKYFQ

SEQ ID NO: 544 - DNA, 702 bp, Brassica napus
atggtggttttatcacagccagtcgctttagataatcacatatcagtaatcccaacatacaagccagttccggttctaacatcccattcaatccccgtcgtggacctaacccacccagaagccaaaacccttatcgtgaaagcttgtgaggagtttggtttcttcaaggttgtcaaccacggagtgtgccctgacctcatgacccggttagagcaggaagctgtcggcttcttcgccttgcctcagtctctcaaaaaccaggccggtccacctgaaccgtacggctatggtagtaaacggattggaccaaacggtgacgtggggtggattgagtatatcctcctcaatgctaaccctcagctctcgtcagccaaaacctctgccgttttcagtcaaagcccactaattttccgtgaggcagtggaggaatacatgaaagaggtgaaggaagtgtcgtgcaaagtgttggagatgataactgaaggattggggatagagccaagggacagtctgagtaagatggtgagagatgagaagagtgactcgtgcctgagactgaaccactatccgacggcggaggaagaggcggagaagatggtgaagttagatggaagctgggtcgctgtccctcctgatcactcatctttcttcattaatgttggagatgctcttcagtttaactgggctggtcaaaactcataa

SEQ ID NO: 545 - protein, 233 aa, Brassica napus
MVVLSQPVALDNHISVIPTYKPVPVLTSHSIPVVDLTHPEAKTLIVKACEEFGFFKVVNHGVCPDLMTRLEQEAVGFFALPQSLKNQAGPPEPYGYGSKRIGPNGDVGWIEYILLNANPQLSSAKTSAVFSQSPLIFREAVEEYMKEVKEVSCKVLEMITEGLGIEPRDSLSKMVRDEKSDSCLRLNHYPTAEEEAEKMVKLDGSWVAVPPDHSSFFINVGDALQFNWAGQNS

SEQ ID NO: 546 - DNA, 555 bp, Brassica napus
atggagaaatttgcttcggaatcggaggctctagcttatactttggcagaggttcttgcagagaaatcaggaagaaaatcaaatttctttaaagaaaaatgtgttagaaacacatgttatctaaggatgaaccgttatccaccttgtccaaaaccatcagaggtgtacggtttaatgcctcacacggacagtgatttcctcacaatcttgtatcaagaccaagtcggaggactccaactcattaaagacaatagatggatcgccgttaaacctaaccctcgtgctctcattatcaatatcggtgacttatttcaggcatggagcaatggcatgtacaaaagtgtggagcatcgtgtgatgacgaatccaacggtggagagattctcaacggcgtattttctgtgtccatcatacgacgccgttatagagtgttcaggtgattgtcctacttatagaaatttcagcttcagagaattcagacaacaagttcaagaagatgttaagaagcttggttataaagttggcctccctaggttcgttaatcatctttactga

SEQ ID NO: 547 - protein, 184 aa, Brassica napus
MEKFASESEALAYTLAEVLAEKSGRKSNFFKEKCVRNTCYLRMNRYPPCPKPSEVYGLMPHTDSDFLTILYQDQVGGLQLIKDNRWIAVKPNPRALIINIGDLFQAWSNGMYKSVEHRVMTNPTVERFSTAYFLCPSYDAVIECSGDCPTYRNFSFREFRQQVQEDVKKLGYKVGLPRFVNHLY

SEQ ID NO: 548 - DNA, 639 bp, Brassica napus
atggttgtttcgttaaagccaaaaccagtcactcttaataatagccaaatctattttaacccaaaatgcaaaacgagtccggttctagtcccggttgtaaatttaaccgacccaaatgccaaaacccaaatcgtaaaggcttgcgaggagttcggattcttcaaagtcgtcaaccatggggtcagaccagagtttttgacccagttggaagaagaggccatcaaattctttgctttgccacagtctcataaagacaaggcgggtccatccgacccgtttgggtacggtagtaaacggatcggacctaatggtgatgtaggctggattgagtatattctcctcaatgctaatagtgataccaaaaccatcgccgtgttccggcaaaccacgccaactttcagagaggtggtggaagtgtacatggaggagatgaaggacatgtctagcaaagttcttgagatggtagctgaagaattaaagatagagccaaaggagaagctaagcaaactggtgaaggtgaaggagagtgattcgtgtctgaggatgaaccattacccggagaaggaggagactcgagacaaggaagaggttgggttcggtgagcatacagatccacagttagtgtcagtgcttaggtag

SEQ ID NO: 549 - protein, 212 aa, Brassica napus
MVVSLKPKPVTLNNSQIYFNPKCKTSPVLVPVVNLTDPNAKTQIVKACEEFGFFKVVNHGVRPEFLTQLEEEAIKFFALPQSHKDKAGPSDPFGYGSKRIGPNGDVGWIEYILLNANSDTKTIAVFRQTTPTFREVVEVYMEEMKDMSSKVLEMVAEELKIEPKEKLSKLVKVKESDSCLRMNHYPEKEETRDKEEVGFGEHTDPQLVSVLR

SEQ ID NO: 550 - DNA, 558 bp, Brassica napus
atggcagtcttgtctaaaccagcagcagaaccaaaatttgggttttctccaatcccggttatagatatctctgacccagaatccaaacaggccatcgtcaaagcctgtgaagactttgggttcttcaaggtgatcaaccatggcgtttcctctgaactagtctctgttttggaacaagaggccgtcaagttcttctcattgcccaagtccgagaaaacccaactcgcaggttatccgtttggatatgggagcagagagattggtcggaatggtgacgtgggttgggttgagtacttgctgatgaacgctaatcttgactttggttcggttccattcccaggaatcttcagaaacgcattgtcagagtacacaacatcagtaaggaaaatgacatgccatgttttggagatgattactgatgggttagggatcaaacagagggacacacttagcaagcttgtgtgtgattcaaacactgattcgatgttcagacttaatcactatccaccatgccctcttatcaacaaaaacaccaatggtggcaagaattcttactga

SEQ ID NO: 551 - protein, 185 aa, Brassica napus
MAVLSKPAAEPKFGFSPIPVIDISDPESKQAIVKACEDFGFFKVINHGVSSELVSVLEQEAVKFFSLPKSEKTQLAGYPFGYGSREIGRNGDVGWVEYLLMNANLDFGSVPFPGIFRNALSEYTTSVRKMTCHVLEMITDGLGIKQRDTLSKLVCDSNTDSMFRLNHYPPCPLINKNTNGGKNSY

SEQ ID NO: 552 - DNA, 648 bp, Brassica napus
atggttgtttcgttaaagccaaagtcagtcactcttaataatagccaagtccatgttaacccaaaatgcaaaccgagtccggttctaatcccggttgtaaatttaaccgatccaaatgccaaaacccaaatcgtaaaggcttgcgaggagttggggttcttcaaagttgtcaaccatggggtcagaccagagtttttgacccagttggaagaagaggccatcaaattctttgctttgccacagtttcataaagacaaggcgggtccagccgacccgtttgggtacggtagtaaacggatcggacctaatggtgatgtaggctggattgagtatattctgctcaatgctaatagtgatactaaaaccaccgccgtgttcctgcaaaccactccaactttcagagaggtggtggtcctggtggaagtgttcatggaggagatgaaggatatgtctagcaaagttcttgatatggtagctgaagagttaaagatagagccaaaggataagctaagcaaactggtgaaggtgaaggagagtgattcgtgtctgaggatgaaccattacccggagaaggaggagactagacgcaaggaagagattgggttcggtgagcatacagatccacagttagtgtcagtgcttaggtag

SEQ ID NO: 553 - protein, 215 aa, Brassica napus
MVVSLKPKSVTLNNSQVHVNPKCKPSPVLIPVVNLTDPNAKTQIVKACEELGFFKVVNHGVRPEFLTQLEEEAIKFFALPQFHKDKAGPADPFGYGSKRIGPNGDVGWIEYILLNANSDTKTTAVFLQTTPTFREVVVLVEVFMEEMKDMSSKVLDMVAEELKIEPKDKLSKLVKVKESDSCLRMNHYPEKEETRRKEEIGFGEHTDPQLVSVLR

SEQ ID NO: 554 - DNA, 630 bp, Brassica napus
atggtagttttgttacagccagtcacatttaatagcgacgtctatgttaacccaaaatgcaaaccaagtccggtcccagtcccggttatagacttaaccgacgcagatgccaaaacccaaatcgtgaaggcttgcgaggagttggggttcttcaaagtggtcaaccacggagtacgacccgatcttttaacccagttggaggaagaggccaacaagttctttgctatgcctcagtatctcaaagaaaaagcgggtccacccgacccgtttggatacggtagtaaacggatcggacccagtggtgacatgggctggttagagtatattctcctcaatgctaatcatcatctctcgtctaccaaaaccactgccgttttccagcaaacccatgcaactttcagagaggcggtggaagagtacatggatgagatgaagcgaatggcttgcaatgttctggagatggtagaagaagagctaagtatagagccaaaggagaagctgagcaaactggtgaaggtggaagagagtgattcttgtctgagggtgaaccattacccggagaaggaagagactccggccaaggaagagattgggttcggtgagcacacggatccacagattctcggttga

SEQ ID NO: 555 - protein, 209 aa, Brassica napus
MVVLLQPVTFNSDVYVNPKCKPSPVPVPVIDLTDADAKTQIVKACEELGFFKVVNHGVRPDLLTQLEEEANKFFAMPQYLKEKAGPPDPFGYGSKRIGPSGDMGWLEYILLNANHHLSSTKTTAVFQQTHATFREAVEEYMDEMKRMACNVLEMVEEELSIEPKEKLSKLVKVEESDSCLRVNHYPEKEETPAKEEIGFGEHTDPQILG

SEQ ID NO: 556 - DNA, 624 bp, Brassica napus
atgacgatattgcctaaaccggtcgaagaaccaaaatccgggttttctccaatcccggttatagatatctctgacccagagtccaaacacgccatggtaaaagcctgtgaagactttgggttcttcaaggtgatcaaccatggagtaccctcggagctagtatctgttttggaacacgaggctgtcgagttcttctcattgcccacgtccgacaaaaaccaagtcgcaggttatccctttggatacgggaacggaaagattggtcggaatggtgacgttggttgggttgagtacttgttgatgaatgtcaatcttgatatcggttcggatccgttccttccggctctcttgaataaccgagaaactataaggaacgcagtgttggagtacacaacatcagcgaggaaaatgacatgtgatgttttggagatgattactgatgggttagggatcaaaccgaggaacacacttagcaagcttgtctctgatcaaaacagtgactcgaaattcagacttaatttttatccaccatgccctctcatcaacgaaaatatctatggtggcaacaatgtgatagatccgtcctccttcttcttcaacgtcggcgactctctccaggtttga

SEQ ID NO: 557 - protein, 207 aa, Brassica napus
MTILPKPVEEPKSGFSPIPVIDISDPESKHAMVKACEDFGFFKVINHGVPSELVSVLEHEAVEFFSLPTSDKNQVAGYPFGYGNGKIGRNGDVGWVEYLLMNVNLDIGSDPFLPALLNNRETIRNAVLEYTTSARKMTCDVLEMITDGLGIKPRNTLSKLVSDQNSDSKFRLNFYPPCPLINENIYGGNNVIDPSSFFFNVGDSLQV

SEQ ID NO: 558 - DNA, 630 bp, Brassica napus
atgactatattgcctaaactggtcgaagaactaaaatcggggttttctccaatcccggttatagatatctctgacccagagtccaaacaggccctggtaaaagcctgtgaagactttgggttcttcaaggtgatcaaccatggagtaccctcggagctagtatctgttttggaacacgaggctgtcaagttcttctcattgcccacgtcctacaaaaaccaagtcacaggttatccctttggatacgggaacggaaaaattggtcggaatggtgacgttggttgggttgagtacttgttgatgaatgtcaatcttgatatcggttcggatccgttccttccgggtctcttgaataaccgagaaactataaggaacgcagtgttggagtacacaacatcagtgaggaaaatgacatgtgatgttttggagatgattactgatgggttagggatcaaaccgaggaacacacttagcaagcttgtctctgatcaaaacagtgactcgaaattcagacttaatcattatccaccatgccctctcatccacgaaaatatcgatggtgcatgcaacaatgtgatcatagatccgtcctccttcttcttcaacgtctgcgactctctccaggtttga

SEQ ID NO: 559 - protein, 209 aa, Brassica napus
MTILPKLVEELKSGFSPIPVIDISDPESKQALVKACEDFGFFKVINHGVPSELVSVLEHEAVKFFSLPTSYKNQVTGYPFGYGNGKIGRNGDVGWVEYLLMNVNLDIGSDPFLPGLLNNRETIRNAVLEYTTSVRKMTCDVLEMITDGLGIKPRNTLSKLVSDQNSDSKFRLNHYPPCPLIHENIDGACNNVIIDPSSFFFNVCDSLQV

SEQ ID NO: 560 - DNA, 1068 bp, Brassica napus
atggttgcaagctggccagagccgattgtttccgttcaaaccttgtcccaagccggcatatccaccgtcccaaaccgctatgttaaaccggttcatcagagaccggtctacaactccgaccaatccggtcttgacatggaagtacccgtgctagacatgagagacgtgtggaggaagccggaggggctgaggcgcgtgaggaatgcgtgtgaggagtggggtttcttccaagtggtgaaccatggtgtagaccatgcgctgatggagagtgtgaggggagcgtggcgagagttctttgatttacccgtagaggtgaaacgaaagtacgcaaactcaccagacacatatgaaggctatggaagcagggttggggttgtgaaagatgctaagttagattggagtgattatttctttctcaattacttgccttcttccattagaaacccttccaagtggccatctcagcctcctaagataaggtatagagaattgatcgaagagtacggagaagaagtgagaaaactgtgtgagaggctagtggagacattgtcagagagtttaggtttagaaccaaaccatctcatgaaggcctttggaggagaagacaaagttggagctaatctgagagcaaacttttacccaaaatgccctcagccacacctaactttaggtctctcttctcattctgacccgggtggcatcaccattgtcctccccgacgaggaggtcgctggcctccaggtccgtcgtggtgactgctgggtcaccattaaatccgtgcccaatgctttgatcgttaacattggagatcaagttcagatacttagcaacggaatttacaaaagcgtggagcatcaggtggtcgttaattccggtatggatcgagtctccttggcactcttctacaacccgagaagtgatatcccgatcggaccggttaaagcactattaaccaaagaccgacctgctctttataaaccgatcaggttcgacgagtaccgccttctgattcgacaaaagggtcctagtgggaaaaaccaagttgattcactgttggcaagcacatga

SEQ ID NO: 561 - protein, 355 aa, Brassica napus
MVASWPEPIVSVQTLSQAGISTVPNRYVKPVHQRPVYNSDQSGLDMEVPVLDMRDVWRKPEGLRRVRNACEEWGFFQVVNHGVDHALMESVRGAWREFFDLPVEVKRKYANSPDTYEGYGSRVGVVKDAKLDWSDYFFLNYLPSSIRNPSKWPSQPPKIRYRELIEEYGEEVRKLCERLVETLSESLGLEPNHLMKAFGGEDKVGANLRANFYPKCPQPHLTLGLSSHSDPGGITIVLPDEEVAGLQVRRGDCWVTIKSVPNALIVNIGDQVQILSNGIYKSVEHQVVVNSGMDRVSLALFYNPRSDIPIGPVKALLTKDRPALYKPIRFDEYRLLIRQKGPSGKNQVDSLLAST

SEQ ID NO: 562 - DNA, 990 bp, Arabidopsis thaliana
atggcggtattgtctaaaccggtagcaataccaaaatccgggttctctctaatcccggttatagatatgtctgacccagaatccaaacatgccctcgtgaaagcatgcgaagacttcggcttcttcaaggtgatcaaccatggcgtttccgcagagctagtctctgttttagaacacgagaccgtcgatttcttctcgttgcccaagtcagagaaaacccaagtcgcaggttatcccttcggatacgggaacagtaagattggtcggaatggtgacgtgggttgggttgagtacttgttgatgaacgctaatcatgattccggttcgggtccactatttccaagtcttctcaaaagcccgggaactttcagaaacgcattggaagagtacacaacatcagtgagaaaaatgacattcgatgttttggagaagatcacagatgggctagggatcaaaccgaggaacacacttagcaagcttgtgtctgaccaaaacacggactcgatattgagacttaatcactatccaccatgtcctcttagcaataagaaaaccaatggtggtaagaatgtgattggttttggtgaacacacagatcctcaaatcatctctgtcttaagatctaacaacacttctggtctccaaattaatctaaatgatggctcatggatctctgtccctcccgatcacacttccttcttcttcaacgttggtgactctctccaggtgatgacaaatgggaggttcaagagcgtgaggcatagggttttagctaactgtaaaaaatctagggtttctatgatttacttcgctggaccttcattgactcagagaatcgctccgttgacatgtttgatagacaatgaggacgagaggttgtacgaggagtttacttggtctgaatacaaaaactctacctacaactctagattgtctgataataggcttcaacaattcgaaaggaagactataaaaaatctcctaaattga

SEQ ID NO: 563 - protein, 329 aa, Arabidopsis thaliana
MAVLSKPVAIPKSGFSLIPVIDMSDPESKHALVKACEDFGFFKVINHGVSAELVSVLEHETVDFFSLPKSEKTQVAGYPFGYGNSKIGRNGDVGWVEYLLMNANHDSGSGPLFPSLLKSPGTFRNALEEYTTSVRKMTFDVLEKITDGLGIKPRNTLSKLVSDQNTDSILRLNHYPPCPLSNKKTNGGKNVIGFGEHTDPQIISVLRSNNTSGLQINLNDGSWISVPPDHTSFFFNVGDSLQVMTNGRFKSVRHRVLANCKKSRVSMIYFAGPSLTQRIAPLTCLIDNEDERLYEEFTWSEYKNSTYNSRLSDNRLQQFERKTIKNLLN

SEQ ID NO: 564 - DNA, 1026 bp, Arabidopsis thaliana
atggtggttttgccacagccagtcactttagataaccacatctccctaatccccacatacaaaccggttccggttctcacttcccattcaatccccgtcgtcaacctagccgatccggaagcgaaaacccgaatcgtaaaagcctgcgaggagttcgggttcttcaaggtcgtaaaccacggagtccgacccgaactcatgactcggttagagcaggaggctattggcttcttcggcttgcctcagtctcttaaaaaccgggccggtccacctgaaccgtacggttatggtaataaacggattggaccaaacggtgacgttggttggattgagtatctcctcctcaatgctaatcctcagctctcctctcctaaaacctccgccgttttccgtcaaacccctcaaattttccgtgagtcggtggaggagtacatgaaggagattaaggaagtgtcgtacaaggtgttggagatggttgccgaagaactagggatagagccaagggacactctgagtaaaatgctgagagatgagaagagtgactcgtgcctgagactaaaccattatccggcggcggaggaagaggcggagaagatggtgaaggtggggtttggggaacacacagacccacagataatctcagtgctaagatctaataacacggcgggtcttcaaatctgtgtgaaagatggaagttgggtcgctgtccctcctgatcactcttctttcttcattaatgttggagatgctcttcaggttatgactaacgggaggttcaagagtgttaaacacagggtcttagccgatacaaggagatcgaggatttcaatgatatatttcggcggaccgccattgagccagaagatcgcaccattgccatgccttgtccctgagcaagatgattggctttacaaagaattcacttggtctcaatacaaatcttctgcttacaagtctaagcttggtgattatagacttggtctctttgagaaacaacctcttctcaatcataaaacccttgtatga

SEQ ID NO: 565 - protein, 341 aa, Arabidopsis thaliana
MVVLPQPVTLDNHISLIPTYKPVPVLTSHSIPVVNLADPEAKTRIVKACEEFGFFKVVNHGVRPELMTRLEQEAIGFFGLPQSLKNRAGPPEPYGYGNKRIGPNGDVGWIEYLLLNANPQLSSPKTSAVFRQTPQIFRESVEEYMKEIKEVSYKVLEMVAEELGIEPRDTLSKMLRDEKSDSCLRLNHYPAAEEEAEKMVKVGFGEHTDPQIISVLRSNNTAGLQICVKDGSWVAVPPDHSSFFINVGDALQVMTNGRFKSVKHRVLADTRRSRISMIYFGGPPLSQKIAPLPCLVPEQDDWLYKEFTWSQYKSSAYKSKLGDYRLGLFEKQPLLNHKTLV

SEQ ID NO: 566 - DNA, 1008 bp, Arabidopsis thaliana
atggtaattgtgttacagccagccagttttgatagcaacctctatgttaatccaaaatgcaaaccgcgtccggttttaatccctgttatagacttaaccgactcagatgccaaaacccaaatcgtcaaggcatgtgaagagtttgggttcttcaaagtcatcaaccatggggtccgacccgatcttttgactcagttggagcaagaagccatcaacttctttgctttgcatcactctctcaaagacaaagcgggtccacctgacccgtttggttacggtactaaaaggattggacccaatggtgaccttggctggcttgagtacattctccttaatgctaatctttgccttgagtctcacaaaaccaccgccattttccggcacacccctgcaattttcagagaggcagtggaagagtacattaaagagatgaagagaatgtcgagcaaatttctggaaatggtagaggaagagctaaagatagagccaaaggagaagctgagccgtttggtgaaagtgaaagaaagtgattcgtgcctgagaatgaaccattacccggagaaggaagagactccggtcaaggaagagattgggttcggtgagcacactgatccacagttgatatcactgctcagatcaaacgacacagagggtttgcaaatctgtgtcaaagatggaacatgggttgatgttacacctgatcactcctctttcttcgttcttgtcggagatactcttcaggtgatgacaaacggaagattcaagagtgtgaaacatagagtggtgacaaatacaaagaggtcaaggatatcgatgatctacttcgcaggtcctcctttgagcgagaagattgcaccattatcatgccttgtgccaaagcaagatgattgcctttataatgagtttacttggtctcaatacaagttatctgcttacaaaactaagcttggtgactataggcttggtctctttgagaaacgacctccattttctctatccaatgtttga

SEQ ID NO: 567 - protein, 335 aa, Arabidopsis thaliana
MVIVLQPASFDSNLYVNPKCKPRPVLIPVIDLTDSDAKTQIVKACEEFGFFKVINHGVRPDLLTQLEQEAINFFALHHSLKDKAGPPDPFGYGTKRIGPNGDLGWLEYILLNANLCLESHKTTAIFRHTPAIFREAVEEYIKEMKRMSSKFLEMVEEELKIEPKEKLSRLVKVKESDSCLRMNHYPEKEETPVKEEIGFGEHTDPQLISLLRSNDTEGLQICVKDGTWVDVTPDHSSFFVLVGDTLQVMTNGRFKSVKHRVVTNTKRSRISMIYFAGPPLSEKIAPLSCLVPKQDDCLYNEFTWSQYKLSAYKTKLGDYRLGLFEKRPPFSLSNV

SEQ ID NO: 568 - DNA, 966 bp, Arabidopsis thaliana
atggtgaaagggtcccagaaaatcgtggccgtagatcaagacataccaataatagacatgtcgcaggagagatcacaagtgtcgatgcagatagtcaaagcctgcgagagtctcggcttcttcaaagtcatcaaccatggcgttgaccaaaccaccatctcaagaatggagcaagagtctataaacttctttgctaaaccggctcacgagaagaaatctgtccgaccagttaaccagcctttccggtatggttttagagacattggactcaacggtgactctggtgaggtcgagtatttgctgtttcacactaacgaccctgcctttcgctctcagctctccttcagctcggcagtgaattgttacatagaagcagttaagcagttggctcgtgagatcttagatctgacggctgagggacttcatgtcccacctcacagtttcagtaggttaatcagctccgtcgatagtgactccgttctgagagtgaatcattatccaccgtccgatcaattctttggtgaagccaatctttctgaccaatctgtgtcactgacaagagttggcttcggagaacacaccgaccctcagattttaacagttcttagatctaacggtgtaggagggctccaagtgtccaattcagatggcatgtgggtttctgtctcccctgacccttcagctttctgcgtcaatgtaggagacttgttacaggtgatgacgaacgggagatttataagtgtaaggcatagagcattgacctacggagaagaaagccggctatccacggcgtactttgccggaccaccgcttcaggcgaagattgggcctctttcggcgatggttatgacgatgaatcagccacggttgtaccaaacatttacttggggcgagtacaagaaacgtgcgtactctctacgacttgaggatagccgtttagacatgtttcgtacatgtaaggactag

SEQ ID NO: 569 - protein, 321 aa, Arabidopsis thaliana
MVKGSQKIVAVDQDIPIIDMSQERSQVSMQIVKACESLGFFKVINHGVDQTTISRMEQESINFFAKPAHEKKSVRPVNQPFRYGFRDIGLNGDSGEVEYLLFHTNDPAFRSQLSFSSAVNCYIEAVKQLAREILDLTAEGLHVPPHSFSRLISSVDSDSVLRVNHYPPSDQFFGEANLSDQSVSLTRVGFGEHTDPQILTVLRSNGVGGLQVSNSDGMWVSVSPDPSAFCVNVGDLLQVMTNGRFISVRHRALTYGEESRLSTAYFAGPPLQAKIGPLSAMVMTMNQPRLYQTFTWGEYKKRAYSLRLEDSRLDMFRTCKD

SEQ ID NO: 570 - DNA, 990 bp, Arabidopsis thaliana
atggttttgccatcttcaacaccgttacaaaccaccggaaagaagacgatatcctcgccggaatataacttcccggtgatcgatttctccttaaacgatcggtcaaaactatcggagaagatcgtaaaagcctgtgaggttaatgggtttttcaaggtgataaaccatggagttaaaccggagataataaagagattcgagcatgaaggagaagagttctttaataaaccggaatcagataagctacgagccggtccggcgagtccgttcggttacggatgcaagaacatcgggttcaacggcgatttgggtgagcttgagtatcttcttctccacgcaaatccgacagctgtcgctgataaatctgaaactatatctcatgatgatcctttcaagttcagctcggcgacgaatgattacatacgcacggttagagatttggcatgtgagatcattgatctgacgatcgagaatttatggggacagaagtctagcgaagtgagtgagctgatcagagacgttcgtagcgattcgatcctacggttgaatcactatccaccagcaccgtacgcgttaagtggcgttggtcaaataggtttcggagaacattctgaccctcagatcttgacggtgttaagatccaacgacgtagatggacttgagatttgctcacgtgacggcttgtggatcccaatcccatctgaccctacatgcttcttcgtattggtcggtgactgccttcaggcattgacgaatgggagattcactagcgtgaggcatagggttttagcaaacacagcaaagaagccacgtatgtcggcgatgtactttgcagctccaccgttagaggcgaaaatatcaccgttgccaaaaatggtgtcgccggaaaatccaagacgttataattcattcacatggggtgactacaaaaaagctacatactctctccgtttagatgtccctcgtctcgagtttttcaagactttatag

SEQ ID NO: 571 - protein, 329 aa, Arabidopsis thaliana [sequence omitted]

SEQ ID NO: 572 - DNA, 1011 bp, Arabidopsis thaliana
atggcttctcaacctccctttaagacaaatttctgctcgattttcggaagctcatttccaaattcaactagtgagagcaatacaaacacatcaactatccaaacctcaggcataaagcttcctgtgatcgatctcagccatctaactagtggtgaggaggtcaaacgcaaaagatgtgtgaaacaaatggttgcagctgcgaaagagtggggattttttcaaattgtgaaccatggaattcccaaagacgtctttgagatgatgctcctcgaagagaagaaactctttgaccaacctttttctgtgaaagtcagagaacgtttttcggacttatcgaagaatagttaccgttggggaaaccctagcgccacttctcccgctcagtactccgtttcggaagcgtttcacatcattctttcagaggtttcaaggatttctgatgatcgcaacaacctcagaacaatcgttgaaacgtatgtgcaagagatagctcgagtggcacaaatgatatgtgaaatactggggaaacaagtgaacgtgagttcggagtatttcgaaaacatttttgagcttgaaaacagttttctaaggctcaataagtaccatcctagtgtttttggttctgaagtgtttggtttggttcctcataccgatacaagttttctcactatactctctcaagatcaaatcggagggttagaattggaaaataatggacaatggatcagcgtaaaaccttgcttggaagcccttacagtcaacattggggatatgtttcaggcactgagtaatggagtgtaccaaagcgtgagacatagagtgatttctccagcaaatatcgagaggatgtcaatagctttcttcgtatgtccttatctcgaaactgagatcgattgctttgggtatccaaagaagtatagaagattcagtttcagagagtacaaagagcagagtgaacatgatgttaaagaaactggtgataaggtaggcttgtccaggtttctcatttga

SEQ ID NO: 573 - protein, 336 aa, Arabidopsis thaliana
MASQPPFKTNFCSIFGSSFPNSTSESNTNTSTIQTSGIKLPVIDLSHLTSGEEVKRKRCVKQMVAAAKEWGFFQIVNHGIPKDVFEMMLLEEKKLFDQPFSVKVRERFSDLSKNSYRWGNPSATSPAQYSVSEAFHIILSEVSRISDDRNNLRTIVETYVQEIARVAQMICEILGKQVNVSSEYFENIFELENSFLRLNKYHPSVFGSEVFGLVPHTDTSFLTILSQDQIGGLELENNGQWISVKPCLEALTVNIGDMFQALSNGVYQSVRHRVISPANIERMSIAFFVCPYLETEIDCFGYPKKYRRFSFREYKEQSEHDVKETGDKVGLSRFLI

SEQ ID NO: 574 - DNA, 1017 bp, Arabidopsis thaliana
atggatccaccattcaacgaaatatacaataaccttttgtataatcagatcacaaagaaagataacgatgtttctgaaataccctttagcttctcagtcacagccgtcgtcgaggaggtggagcttcctgtgattgacgtcagccgtttgattgatggagccgaggaggagagagagaaatgtaaggaagcgattgcgagagcttcgagggagtggggattttttcaagtgataaaccatggaatatcaatggatgtgttggagaagatgagacaagagcaaattagggtctttagagagccttttgacaagaaaagtaagtcggagaaattttccgccgggagttaccggtggggaacgccgtcagccacttctatccggcagctttcttggtcagaagcttttcatgttcccatgacagatatttctgacaacaaggactttactactctcagctcaacaatggagaaatttgcttcggaatcagaggcattagcatatatgttggcagaggttcttgcagaaaaatctggacaaaattcaagtttcttcaaagaaaactgtgtgagaaatacatgttatctaaggatgaaccgatatccaccttgtcccaaaccatcggaggtgtacggattaatgccacacacggacagtgatttcctcacaatcttgtatcaagatcaagtcggaggactccaacttatcaaagacaatagatggatcgctgttaaacctaatcctaaagctctcattatcaatattggtgacttatttcaggcatggagcaatggcatgtacaaaagtgttgaacaccgtgtgatgacgaacccaaaggtggagagattctcaacggcttattttatgtgtccatcatacgacgccgttatagagtgttcaagtgatcgtcctgcttatagaaatttcagcttcagagaattcagacaacaagttcaagaagatgttaagaagtttggttttaaagttggccttcctaggttccttaatcacgtctactaa

SEQ ID NO: 575 - protein, 338 aa, Arabidopsis thaliana
MDPPFNEIYNNLLYNQITKKDNDVSEIPFSFSVTAVVEEVELPVIDVSRLIDGAEEEREKCKEAIARASREWGFFQVINHGISMDVLEKMRQEQIRVFREPFDKKSKSEKFSAGSYRWGTPSATSIRQLSWSEAFHVPMTDISDNKDFTTLSSTMEKFASESEALAYMLAEVLAEKSGQNSSFFKENCVRNTCYLRMNRYPPCPKPSEVYGLMPHTDSDFLTILYQDQVGGLQLIKDNRWIAVKPNPKALIINIGDLFQAWSNGMYKSVEHRVMTNPKVERFSTAYFMCPSYDAVIECSSDRPAYRNFSFREFRQQVQEDVKKFGFKVGLPRFLNHVY

SEQ ID NO: 576 - DNA, 1161 bp, Physcomitrella patens
atggcgtcgactggggaggtgagtcaaggagaagaagattccgaggatgaggtgcagaagaaacctgagattcccctttactcaatgcaagctttgtgggacgggaagatgtcgttgaaggatttcgaggtgaaaggggaggagaaactcacattacctcacgatgtctttgagcatgacgaggccttacctgtgatcgacatcagcgcgcttttaggtacggacaaaaagattcgggatgagaacatggccgcgatgctggatgcggcgaagacatggggtttcttcaagatccgcaaccacggagtgcctctcgaagtggtaaagaaagtggagagtaatgtgaagaatttttttgcgttgcccatggagaagaaattgatggtgaaggccatcaactttgctttcgggtacgttgggggatccccagtctcctggcggtataaatggtggctggagggactgcacatgaaagttaactaccaggcaataagggacatggtgaatctagtgtggtctgatgacaaagactttgctgaagaattcatatctgacctgaccagttacttcgacaccatgcgatacttatcacgcctgatcgtagaatgcctaactgaaggcctcagcctaccccgcgacacctacaccaaactggaaacggaaaacgctatttgcaatgcgcgtgtgaaccactaccctgcatgtcctgacccgtctaaagtgttcggcatcccaggtcacacagaccctcagatgctgtcaatcctctaccaggacgatgtcggaggcctgcaggtgctcaaggatggcaagtggatcggtatccgtcccgacgactccaccttagtgtgcaatttgggtgatactttccaggtaataactaacggcatactgcacagcgcaggccatcgagtggccgtgaacgccaccaggtcccggtacgcaaccatctacttctacggcattgacaacgtgataccgctgtgcgtgccaccccaactcgtcaccaaagaccggcctctcaagtatcggccgttcactgtacatgaatatagagcacattgcgtagaaaaacaggtccccatagacggagtgaagttcctagagatccagccccagtccaacaatccctcaacctcacagtcgaaatcaccgcaataa

SEQ ID NO: 577 - protein, 386 aa, Physcomitrella patens
MASTGEVSQGEEDSEDEVQKKPEIPLYSMQALWDGKMSLKDFEVKGEEKLTLPHDVFEHDEALPVIDISALLGTDKKIRDENMAAMLDAAKTWGFFKIRNHGVPLEVVKKVESNVKNFFALPMEKKLMVKAINFAFGYVGGSPVSWRYKWWLEGLHMKVNYQAIRDMVNLVWSDDKDFAEEFISDLTSYFDTMRYLSRLIVECLTEGLSLPRDTYTKLETENAICNARVNHYPACPDPSKVFGIPGHTDPQMLSILYQDDVGGLQVLKDGKWIGIRPDDSTLVCNLGDTFQVITNGILHSAGHRVAVNATRSRYATIYFYGIDNVIPLCVPPQLVTKDRPLKYRPFTVHEYRAHCVEKQVPIDGVKFLEIQPQSNNPSTSQSKSPQ

SEQ ID NO: 578 - DNA, 1224 bp, Physcomitrella patens
atgacagcgggagccgagaaacagcccgaagacgggagtcatgaaaagcagaatgtacatttagactcgacgaaacaagctgccgcaagccccgtctacacaatgcaagcttttttcgatggtaagatgaaggtagaggactttgccagatcggagcaggagcggcccactgtcccgcacgatatcttcgacgatacgctccctgtcgttgacatcgccgcgattaaggacggcacggcagaagaacggcgtgccaacgtggtcaaaatgctgaaagcagcaaaatcgtggggttttttcaagatctccaatcacgaaatccccttgcaagtggttctaagtaacctgcaactcatcttcgtcacggccgatcatgcttgtgatgaagcggtgaagcgagtgaagaaaaacggaaagcaattttttgcgctgcccatggagaggaaacttcccgtgcgagcgccagattttgtgtttggttacacaggcggctctccggtcaattggaaatcaaaatggtggctagaagctctaatgatcaaggtcacggacgaggcgttggatgacatgatcggccaagtgtttccagacgaaaaagatttcggcgtacggttcaaggaggatttgaaggcattcttctccccgatgcatgagctctctcgattcatagtggaggaattaaccgaagccctcggcctggagcgtgacaccttcacccgccttgagacgccgggctccaattgcaccggacgcatgaaccactacccagtctgtcccaatccagactctgtgctggggattcctccccacgcagacacgcagttgctgggaattctgcatcaagatgatactggtggactgcaagtactgaaggatggggagtgggtgggaatccagcctgatgattccaccttcgttgtcaacattggtgataccttccaggcgattacgaatgggatccttcgcagtgcagcgcatcgagcagtggttaatgcgaagaaggaccggtactcaactatctacttttacggtattgacaactccatcactctcacagtgccgccaaagctcattaccgaagaccgccctctcaagtatcgcccatttacggtcagggaacacagaaaatacatcgtggacaacgaagtcccgatcaatgctgttcagcacttggagatcaatcccgaagccacggctttattcctcgaaaaattgtttggttaa

SEQ ID NO: 579 - protein, 407 aa, Physcomitrella patens
MTAGAEKQPEDGSHEKQNVHLDSTKQAAASPVYTMQAFFDGKMKVEDFARSEQERPTVPHDIFDDTLPVVDIAAIKDGTAEERRANVVKMLKAAKSWGFFKISNHEIPLQVVLSNLQLIFVTADHACDEAVKRVKKNGKQFFALPMERKLPVRAPDFVFGYTGGSPVNWKSKWWLEALMIKVTDEALDDMIGQVFPDEKDFGVRFKEDLKAFFSPMHELSRFIVEELTEALGLERDTFTRLETPGSNCTGRMNHYPVCPNPDSVLGIPPHADTQLLGILHQDDTGGLQVLKDGEWVGIQPDDSTFVVNIGDTFQAITNGILRSAAHRAVVNAKKDRYSTIYFYGIDNSITLTVPPKLITEDRPLKYRPFTVREHRKYIVDNEVPINAVQHLEINPEATALFLEKLFG

SEQ ID NO: 580 - DNA, 1224 bp, Physcomitrella patens
atgccagttgcgcagcctttacacccgtcgcatcacaagtcgctcatgcacgaagctccaaaccattttagaacactggcgccgaggaatggcctgcaccgagggcaaagcgacaattacagtgggttgcgtccagaagctgtgaaatctaacctgctaagaggcgctagcgctgatttgtccgagttcatttggcccaaggaccaatggccctccgtgtctcacaacgacttccacatggcacaagagttgcccaccgtggacctctcagacctgcaccatggctccgaagagagccgagaggcgacagcaaaattgctagtgaagacgttctccgaatggggattcgtgcaagttatcaaccacggggtgccaacggaggtcatcgagaaaatgcagaaccaagcacggaattttttcgatttgccactggaacaaaaggagaagggcgtcgcgtctagcaccagcaagcacgaaggctttggttatggcgttgaaagtgggttctactacgctggcaagccgtggatcgatcggtttcagtgccgatggagccccgtgtgcgagattcgtgagcccgtcgagaaggtgttcagccccactgacgccgaggagtttagcaccagcatagaggactacaatggccgactggacaagcttgcaatgcaaattttggaactaaccgcacagggtctcggccttccctctgacacgttcatcaagcccttcaacggcacagctggtgactgcattgcccgcatgaactactatccaccgtgtccactttcctctcttactctgggactcggtgctcatacagaccccaacctcttgaccatactgagccaatgtaaagtcggcggattgcaagtctgcaaaaatggcacatggatttcagtgaagcccaaacccgacacgctcattatcaacatcggagacacttttgaggcatggacaaatggacggttctgtagtgtggagcaccgcgctgttgtgaacgaatctgaagccaggatgtcactggtgtatttcgcctcacctccctccaagtccgttattcaaatcccggaacagctcatcaccgcgaagcatcccttgcgcttccggccttccttcacatgggaagaatacaagagccacttgttcaagaggcacgttggaggcaacggcgtcaaaacctcgaaagaatggttgcgattacccgcacccacctcgcacacataa

SEQ ID NO: 581 - protein, 407 aa, Physcomitrella patens
MPVAQPLHPSHHKSLMHEAPNHFRTLAPRNGLHRGQSDNYSGLRPEAVKSNLLRGASADLSEFIWPKDQWPSVSHNDFHMAQELPTVDLSDLHHGSEESREATAKLLVKTFSEWGFVQVINHGVPTEVIEKMQNQARNFFDLPLEQKEKGVASSTSKHEGFGYGVESGFYYAGKPWIDRFQCRWSPVCEIREPVEKVFSPTDAEEFSTSIEDYNGRLDKLAMQILELTAQGLGLPSDTFIKPFNGTAGDCIARMNYYPPCPLSSLTLGLGAHTDPNLLTILSQCKVGGLQVCKNGTWISVKPKPDTLIINIGDTFEAWTNGRFCSVEHRAVVNESEARMSLVYFASPPSKSVIQIPEQLITAKHPLRFRPSFTWEEYKSHLFKRHVGGNGVKTSKEWLRLPAPTSHT

SEQ ID NO: 582 - DNA, 1224 bp, Physcomitrella patens
atgccggtcgcgcagcctctgcatatgtcgcaccacaagtcgctgatgcgcggagtgccaaaccattacagaacaatggcgctgaagaacagcttgcaccgtgggcagagcgacaattatcacaggttgcggcccgaagctgtgaaatccaatcttctgagaggcgcaagtgccgatttgtccgagttcatttggcccaaggaccagtggccttctttagcccacaacgacttccagttggcgcaggagctccctaccgtggacctctcaggcttgctctttggctcagaggaggagagagataagacggcggacttgcttgtgaagatgttctccgaatggggatttgtgcaggtaatcaaccatggagtgccgacggaggttactcaaaaaatgatgatccaagctcggaatttctttgatttgcccttagaacagaaagagaagggcgtcgcgtccagctccagcaaacacgagggattcggctatggtgttgagagtggattctactatgctggaaagccttggatcgaccggttccagtgtcgctggagtcccgtgtgtgagatacgtgagcctgtcgagaaggtgttcagcccctcggacgccgaagaatttagcaacagcatagagagctacaatagccatttggataagctcgcaatgcaaattctggagctttgcgcacgagggcttggactcccccacgacacgttcacaaagcctttcaacggcacagctggcgactgcatcgcccgcatgaactactaccctccatgcccgctctcgtccctcactcttggacttggcgctcacacagaccccaacctcttgaccatcctcagccaatgcaaagtcggcggattgcaagtctgcaaaaacggcacttggatctccgttaaacccaagccggacacgcttgtcatcaacatcggcgacacttttgaggcatggacaaatggacggtttcagagcgtggagcaccgggctgtggtgaatgaaacagaggctcggatgtctctggtgtatttttcctcacctcccaccaagtcgctgattcaaataccggagcagctcatcactgctgagcacccattgaggtttaacccctcgttcacatgggaagagtataaaatgtatctgtttaagaagcatgtcgagggcaacggagtgaaagtcgccaaagactggctgcggagacctgccactacatcgcagaactga

SEQ ID NO: 583 - protein, 407 aa, Physcomitrella patens
MPVAQPLHMSHHKSLMRGVPNHYRTMALKNSLHRGQSDNYHRLRPEAVKSNLLRGASADLSEFIWPKDQWPSLAHNDFQLAQELPTVDLSGLLFGSEEERDKTADLLVKMFSEWGFVQVINHGVPTEVTQKMMIQARNFFDLPLEQKEKGVASSSSKHEGFGYGVESGFYYAGKPWIDRFQCRWSPVCEIREPVEKVFSPSDAEEFSNSIESYNSHLDKLAMQILELCARGLGLPHDTFTKPFNGTAGDCIARMNYYPPCPLSSLTLGLGAHTDPNLLTILSQCKVGGLQVCKNGTWISVKPKPDTLVINIGDTFEAWTNGRFQSVEHRAVVNETEARMSLVYFSSPPTKSLIQIPEQLITAEHPLRFNPSFTWEEYKMYLFKKHVEGNGVKVAKDWLRRPATTSQN

SEQ ID NO: 584 - DNA, 1161 bp, Physcomitrella patens
atggggtcaagtgagttgttgattcatggccaagataatcgtggaggcggtgaggtggaaaagaaatcggagattccgctctacacaatgcaagccttgtgggacggaaaaatatcgctgaaggattttgaagtggtaggaatggataaacctataatacctcacgatgtctttgagccggatgaagcgttacccgtcatcgatgtagaagcgctccttggtgctgacaacgaggctcgacttgagaacatggtcagaatgctagaagcagcaaagacgtggggtttttttaaaattcgcaaccacggcgtgtccctggaagtggtgaagaaagtggaggcgaatgtgaagaaattcttcgcattgcccatggagaagaaactattggtaaaagccaacaacttctctttcgggtatgttgggggatcgccagtcagctggaaatacaagtggtggctagaggggctacatatgaaagttcaagacgaggcaataaagaatattgtggacctggtgtggtccgatgatgaagagttttctacagaattcacagctgatttgacaaactatttcgccatcatgcgagatctgtcacgtctgatcgtagaatgcctgactgaaggcctcggccttccccgtgacacttacaccaaactcgaaacgccgaacgccatttgcaacgcacgtgtgaatcactaccccgcatgtcccgatccgtccagtgtgttcggcatcccaggccacaccgatccccaaatgctgtctattctgtaccaagacgacgtcggaggcctgcaagtgctcaaggatggcaagtggatcggcattcgtcccgatgactctaccttcgtggtgaatctgggcgacacttttcaggtcatttcgaacggcattctgcacagcgcagcccaccgagtcgcggtgaacaccaccaggtcccggtacgcaaccatctatttctacgggatcgacaatgagattccactcttcatcccaccccaacttgtcactaaagagaggccgcttaagtaccggcccttcactgtaaatgaatatagagaacacctagtgataaaacaagttcctatggatggcgtcaagtatctagagatggagcccgagatccaagacgctgcatcgccatccaactcctcacaataa

SEQ ID NO: 585 - protein, 386 aa, Physcomitrella patens
MGSSELLIHGQDNRGGGEVEKKSEIPLYTMQALWDGKISLKDFEVVGMDKPIIPHDVFEPDEALPVIDVEALLGADNEARLENMVRMLEAAKTWGFFKIRNHGVSLEVVKKVEANVKKFFALPMEKKLLVKANNFSFGYVGGSPVSWKYKWWLEGLHMKVQDEAIKNIVDLVWSDDEEFSTEFTADLTNYFAIMRDLSRLIVECLTEGLGLPRDTYTKLETPNAICNARVNHYPACPDPSSVFGIPGHTDPQMLSILYQDDVGGLQVLKDGKWIGIRPDDSTFVVNLGDTFQVISNGILHSAAHRVAVNTTRSRYATIYFYGIDNEIPLFIPPQLVTKERPLKYRPFTVNEYREHLVIKQVPMDGVKYLEMEPEIQDAASPSNSSQ

SEQ ID NO: 586 - DNA, 1173 bp, Physcomitrella patens
atgggggtatcggagatgaaccgaactgaggactgcgttgacgccgacatagtgatgaaagagcccgaagttgagacggccacaattcctacctacacaatgcaagctctgtgggacaagaagctgtcgctgaaggattttgaggtttccggagaggataagcccacattgccttacgatgtctttgagcaggacgaagtgcttcctatcattgacttacaagcgctgcttggaaacgataaggatgcccggtatgtgaaccttgcacggatgctggaagctgccaaaacgtgggggttctttaagattcgcaaccacggcgttgctttggaaacggtaaagaaagtggagcagaatgtgaagaagttctttgcgctgcccatggagaagaaactgcaagtgaaagcggtaaacttcgtattcggatacataggtggatctcctgtcagctggaagaacaaatggtggctagaaagtcttcacatgaaagtacaagaggaggcaatccggaagatggtggcactcgtatggagtgataacccaaagttcgcagacgagttcatgtcggctttgacgcgctactacagctcaatgcgagagctctctcggctgattgtggagtgtttgacggagggcctcggtcttccccccaacacctacaccaaacttgaaacaccagacgccatttgcaatgcgcgtgtgaatcactaccccgcttgtcctgacccatccaaagtgtttggaataccaagccatactgatcctcaaatgctgtcaattctgtatcaagacgacgttggaggtttgcaggtgctcagaaatggaaagtggatcggaattcgaccggatgattctacattagtggtcaaccttggcgacaccttcatggcaattacgaacggcattctgcacagcgcagtgcaccgagtggcgctaaacactacgaggtctcggtattccactatatatttttacggggttgataacgcggcgcctctcagtgtaccacctgagctcatcacagaggaccgcccgctattgtacagacccttcactgtgaatgaatacagagcaatcctcacagagcaccaagttcccgatgacggcataaagttccttcgcatccaacctggggtcactgcaacagccaggaagaaaatgttccgcaggtag

SEQ ID NO: 587 - protein, 390 aa, Physcomitrella patens
MGVSEMNRTEDCVDADIVMKEPEVETATIPTYTMQALWDKKLSLKDFEVSGEDKPTLPYDVFEQDEVLPIIDLQALLGNDKDARYVNLARMLEAAKTWGFFKIRNHGVALETVKKVEQNVKKFFALPMEKKLQVKAVNFVFGYIGGSPVSWKNKWWLESLHMKVQEEAIRKMVALVWSDNPKFADEFMSALTRYYSSMRELSRLIVECLTEGLGLPPNTYTKLETPDAICNARVNHYPACPDPSKVFGIPSHTDPQMLSILYQDDVGGLQVLRNGKWIGIRPDDSTLVVNLGDTFMAITNGILHSAVHRVALNTTRSRYSTIYFYGVDNAAPLSVPPELITEDRPLLYRPFTVNEYRAILTEHQVPDDGIKFLRIQPGVTATARKKMFRR

SEQ ID NO: 588 - DNA, 1131 bp, Physcomitrella patens
atggcatcaaatcaacctccgaatccattttcgctcattcgagcggcttccatcactccggcggcgcagagcagcttgcagtcgctgctgagtcaaggctcgcaggacttggcagatttcgtgtggccggaggatgaacgtccgactattccacacaacgattaccggcgcgatagggagctccctgtcatcgacttgtcaggcttgcaggatgggtccgacgagacgaagatgaaactggcgaagcggattgctgctgccggctcagagtgggggttttttcatctcataaaccatggtatccccgtcgctgacctagacgaggtgcagttacaaacccgacgcttcttcgagcttcccatggagcataagcagcgtgccatgagtcttgagactgccaacgcgaataatgtatatggttacggattgaacactactggatacaagtacgcaggtcgcccctggatcgagcgatttcagtgtagctggtcccccaagtccaatctccgcgagcaggctcagcgtttactcgatggtcaagcctttcacgatttccaagcagctgtggaatccttttgctcaggagcagagaagctggcgaagcttaccctggagttgtgtgctctggggttaggcctggctcctgatacttttagccaacacatgaatcccagccaatcgattgcacgattgaattattaccccgcctgtccgaccccggatctcacccttggtttgggcgcgcacactgatccctacaccctcactttcttacatcaatgtcaagtggggggattacaagtgtgtaaggacgggaaatggatcaccgttaagcctcgacgaggcgcgtatgttgtcaacgtcggagacaatctccaggcatggaccaatggacgattcaagagcgtggagcacagagctgtcctaaacgacaaagtgtcacggctatctctagtatttttttatgctcctcctctagacactgtcatatcagctcctcaagagctgatccaagctgacggcaagcgacgctacaaaagcttcacgtggggagagtatctcgattacttaaagaggcagaattttgagaagggcaagaatgagcgatgggtcgaaggctttgcactttga

SEQ ID NO: 589 - protein, 376 aa, Physcomitrella patens
MASNQPPNPFSLIRAASITPAAQSSLQSLLSQGSQDLADFVWPEDERPTIPHNDYRRDRELPVIDLSGLQDGSDETKMKLAKRIAAAGSEWGFFHLINHGIPVADLDEVQLQTRRFFELPMEHKQRAMSLETANANNVYGYGLNTTGYKYAGRPWIERFQCSWSPKSNLREQAQRLLDGQAFHDFQAAVESFCSGAEKLAKLTLELCALGLGLAPDTFSQHMNPSQSIARLNYYPACPTPDLTLGLGAHTDPYTLTFLHQCQVGGLQVCKDGKWITVKPRRGAYVVNVGDNLQAWTNGRFKSVEHRAVLNDKVSRLSLVFFYAPPLDTVISAPQELIQADGKRRYKSFTWGEYLDYLKRQNFEKGKNERWVEGFAL

SEQ ID NO: 590 - DNA, 987 bp, Medicago truncatula
atggtgctattatccaaaccatcatcagaacaatacacctatgttaggaacaacatgcaagcaactacattttcctcatcaattcctcttgttgacctatcaaaaccagatgcaaagagcctcatagtaaaagcttgtgaagattttggattcttcaaagtcataaaccatggaatccctatggaagctatatcccaattggaatctgaggccttcaaatttttctctctccctctaacagagaaagaaaaagctggtcctgcaaatccatttgggtatggtaacaaaaggattggacccaatggtgatgttggttgggttgaataccttcttctcaataccaatcaagaacataatttctctcttcatggcaaagacatagacaaatttaggtgtttgttgaatgattataagtgtgctatgaggaatatggcatgtgagatacttgatttgatggcagaagggttaaagattcaaccaaagaatgtgtttagcaagcttgtgatggataaacagagtgactctgcttttagggttaatcattaccctgcttgtcctgaattagctataaatggtgaaaatttgattgggtttggagaacacacagaccctcaaattatatcacttttgaggtcaaataatacttcaggatttcaaatttctcttagagatggaagttggatttcagtcccacctgatcatagatccttcttcatcaatgttggtgattctcttcaggttatgactaatgggaggttcaaaagtgtgagacatagagttttggcaaatggtatcaatccaaggctctcaatgatttactttggtggaccacctttgagtgagaaaatagcaccattgccttcactcatgaaaggaaatgaaagcttgtacaaagaatttacatggtttgagtacaagaattctacttatggaacaagattggctgacaataggctgggaaattatgaaaggattgctgcctcctaa

SEQ ID NO: 591 - protein, 328 aa, Medicago truncatula
MVLLSKPSSEQYTYVRNNMQATTFSSSIPLVDLSKPDAKSLIVKACEDFGFFKVINHGIPMEAISQLESEAFKFFSLPLTEKEKAGPANPFGYGNKRIGPNGDVGWVEYLLLNTNQEHNFSLHGKDIDKFRCLLNDYKCAMRNMACEILDLMAEGLKIQPKNVFSKLVMDKQSDSAFRVNHYPACPELAINGENLIGFGEHTDPQIISLLRSNNTSGFQISLRDGSWISVPPDHRSFFINVGDSLQVMTNGRFKSVRHRVLANGINPRLSMIYFGGPPLSEKIAPLPSLMKGNESLYKEFTWFEYKNSTYGTRLADNRLGNYERIAAS

SEQ ID NO: 592 - DNA, 972 bp, Medicago truncatula
atggtgttggcttcaccaaaaccaatgaggaatgaaacgattttaccaaatgatcttattccaatagtagaccttaagagtgaaaggtcagaagtaataaaacaaattgtgaaagcaagtgaagagtatggtttcttcaaggtgataaaccatggtattagtgatggaactattgagaaaatggaagaggcagggtttagtttctttgcaaaaccaatgtctcaaaagaaacaagctgcacctgcttatggttgtaagaacataggattcaatggagatattggtgaggttgagtaccttctcctcaatgcaaacacttcctccattgctcaaatatccaaaactatatccaatgatgatccacattctaacttcaggtgtagggtgagtgaatatacagaagcagtgaaagaggtggcatgtgagatattagagctaatggcagagggtttgggggtccctgatacaaaggttttcagcagtttgataaaggatattgatagtgactcagttcttaggctcaatcactacccacctacacttaacaaggacaagtcacattccaacaatgttggctttggggagcattctgaccctcagatcttgaccattcttagatctaatgacgtttctggtcttcaaatttctcttcaacatggtctctggattcctgttaaccctgacccagaagctctatgtattaatataggtgatgtccttgaggttatgacaaatggaaggtttgtaagcgtgagacatagggcaatgacaaactcatacaaatcaagaatgtcaatggcatattttggggctccacctctaaatgcttccattgttgctccaccagttttggttacaccaaccaggccctctctcttcagaccatttacttgggccgactacaaaaaagccacttactctctaaggcttggtgacaccagaattcaacttttcagagcaaacattgcatga

SEQ ID NO: 593 - protein, 323 aa, Medicago truncatula
MVLASPKPMRNETILPNDLIPIVDLKSERSEVIKQIVKASEEYGFFKVINHGISDGTIEKMEEAGFSFFAKPMSQKKQAAPAYGCKNIGFNGDIGEVEYLLLNANTSSIAQISKTISNDDPHSNFRCRVSEYTEAVKEVACEILELMAEGLGVPDTKVFSSLIKDIDSDSVLRLNHYPPTLNKDKSHSNNVGFGEHSDPQILTILRSNDVSGLQISLQHGLWIPVNPDPEALCINIGDVLEVMTNGRFVSVRHRAMTNSYKSRMSMAYFGAPPLNASIVAPPVLVTPTRPSLFRPFTWADYKKATYSLRLGDTRIQLFRANIA

SEQ ID NO: 594 - DNA, 1011 bp, Medicago truncatula
atggttgttttgtctaagccaacattaaataatttcttacttgtcaagtcatgcaaaccatcaacaactttgttgaatggtattcctgtcgtcgaccttgcagacccggaagcaaaaactcttatagtgaaggcttgtaaggaatttggattcttcaaagtggtgaaccatggtgttcctttggaatttatgtccaatttggaaaatgaagcactaaggtttttcaaaaaaccacagtctgagaaagacagagctggtcctcctgatccttttggttatggaagtaagagaattggttcaaatggtgatgttggttgggttgaatatatccttcttaatactaaccctgatgttatctctaacaagtctctttccttttaccgtgaaaatcgacaaaatctaaggtctgctgtggaagattatattgctgcaatgaagaaaatgtgctgtctagtgttggaattaatggctgatgggttggggattgagccaaagaatgtgttaagcaggttattgaaagatgagaaaagtgattcttgtttcagaattaaccattacccaccgtgccctgaggtgcaacaagcagcattgaatggaaggaatttgcttgggtttggggagcatacagacccacaagtcatttctgtcttgagatctaatagcacatcaggactgcaaatctgtctcactgatggaacttgggtttcagttccacctgatcacacttcttttttcatcaatgttggtgatactcttcaggtattgactaatggtaggtttaaaagtgtaaagcatagggttttggctgacacaacaaagtcaaggttgtcgatgatatactttggaggaccacccttgagtgaaaagatagtgcctttaccttctttaatgttaaaaaaagaagaaagtttgtacaaagagttcacgtggttggagtacaagaaagcaatgtacaattcaaggctggctgattatagacttgggccttttgaaaaatcttatggcaaatga

SEQ ID NO: 595 - protein, 336 aa, Medicago truncatula
MVVLSKPTLNNFLLVKSCKPSTTLLNGIPVVDLADPEAKTLIVKACKEFGFFKVVNHGVPLEFMSNLENEALRFFKKPQSEKDRAGPPDPFGYGSKRIGSNGDVGWVEYILLNTNPDVISNKSLSFYRENRQNLRSAVEDYIAAMKKMCCLVLELMADGLGIEPKNVLSRLLKDEKSDSCFRINHYPPCPEVQQAALNGRNLLGFGEHTDPQVISVLRSNSTSGLQICLTDGTWVSVPPDHTSFFINVGDTLQVLTNGRFKSVKHRVLADTTKSRLSMIYFGGPPLSEKIVPLPSLMLKKEESLYKEFTWLEYKKAMYNSRLADYRLGPFEKSYGK

SEQ ID NO: 596 - DNA, 969 bp, Medicago truncatula
atggtggtggcttccccaaattcgatcttaggggaaaggattatacctattgacctaccaatgatagacctatcagctgaaaaatcaatggtaataaaactcatagtaaaagcttgtgaagaatatggtttcttcaatgtgattaaccatggtgtccctcatgacatcatatccaaaatggaagaagtaggttttgatttctttgcaaaaccaatggaacaaaagaaactagttgcacttggtaatccctttggttatggatgcaagaatattgggttcaatggagacatgggtgaggtggaatatcttcttctcaatgccaatgctccttctattcctaatgattcatcaaacttcagctctagtgtaagtgcatatacagaagctgtgaaggagctggcatgtgagatattggagctaatggcagaaggtttgggggtccctgatacatccattttcagcacattcatcactcaacttgataatgactcactccttaggttcaatcactaccctcctaaagactgcaaagatagagacaactctaattcctacaacgttggctttggagaacattctgaccctcagattcttactatccttagatccaacgatgttgctggtctccaaatttcacttcaacatggtgtgtggaacccagttactcctgacccagctgctttctgtgttaacgttggtgatcttcttgaggttatgacaaatggaagatttgtaagcgtgagacatagggctgtgaccaactcatacaagtctagaatgtcggtggcatattttggggctccaccacttgatgcatgcattgttgctccctcagttatggttacaccaaacaggccctctcttctcttcaaaccattcacttgggcagaatacaagaaagtcacttactctctaaggcttggagacagccgcattgaccttttcaagaattgcacacaaatagagtaa

SEQ ID NO: 597 - protein, 322 aa, Medicago truncatula
MVVASPNSILGERIIPIDLPMIDLSAEKSMVIKLIVKACEEYGFFNVINHGVPHDIISKMEEVGFDFFAKPMEQKKLVALGNPFGYGCKNIGFNGDMGEVEYLLLNANAPSIPNDSSNFSSSVSAYTEAVKELACEILELMAEGLGVPDTSIFSTFITQLDNDSLLRFNHYPPKDCKDRDNSNSYNVGFGEHSDPQILTILRSNDVAGLQISLQHGVWNPVTPDPAAFCVNVGDLLEVMTNGRFVSVRHRAVTNSYKSRMSVAYFGAPPLDACIVAPSVMVTPNRPSLLFKPFTWAEYKKVTYSLRLGDSRIDLFKNCTQIE

SEQ ID NO: 598 - DNA, 999 bp, Medicago truncatula
atggttgttctttctcaacaagctacactaaacgagttatttcacataaacacatgcaaaccaacaagttatgtattcaaaggtgttccagaggttgacctttcagacccagaagctaagacactaatagtcaacgcatgtacagaatttggattctttaaggttgttaaccaccaagttccgttagagttgataaccaatttagaaaatgaaacactcaaattttttggacaacctcagttagagaaagagaaagcaggtccacctgatccttttgggtatggaagcaaaattattggtacaaacggtgatgtgggttgggttgaatatcttcttcttaatactaacccagatgtcatctctctcaagtctctttttcttttacagcaaaacacaaaaaacttcaggtgtgctgctgaagaatatatagtggcagtgaaggaggtgtgttgtgaagtattggaattaatggcagatggattgaggattgaaccaaggaatgtgtttagcagattggtgagagatgagagaagtgattcttgtttgagggtaaatcactacgcggcatgtggagaacttcaagcattgagtggaggaaatttgattggatttggggagcatactgacccacagataatatctgtcctaaggtctaataatgcatcaggactgcaaatttgtctcagagatgggacttgggtttcaatcccacctgatcacacttctttcttcataagtgttggtgactccttacaggtgattacaaatggggaattaaagagtgtaaagcatagggtattgactgacacaagtatgtcaaggttgtcaatgatttattttggagggccacccttgaatgaaaagttagtacctttgccttcaatattgggatcaaaagaacaacagagtttgtacaaagaattcacatggagggaatacaaaaatgctgcttacaagtcaaagcttgcttataataggctcagtctctttgagaaataa

SEQ ID NO: 599 - protein, 332 aa, Medicago truncatula
MVVLSQQATLNELFHINTCKPTSYVFKGVPEVDLSDPEAKTLIVNACTEFGFFKVVNHQVPLELITNLENETLKFFGQPQLEKEKAGPPDPFGYGSKIIGTNGDVGWVEYLLLNTNPDVISLKSLFLLQQNTKNFRCAAEEYIVAVKEVCCEVLELMADGLRIEPRNVFSRLVRDERSDSCLRVNHYAACGELQALSGGNLIGFGEHTDPQIISVLRSNNASGLQICLRDGTWVSIPPDHTSFFISVGDSLQVITNGELKSVKHRVLTDTSMSRLSMIYFGGPPLNEKLVPLPSILGSKEQQSLYKEFTWREYKNAAYKSKLAYNRLSLFEK

SEQ ID NO: 600 - DNA, 972 bp, Medicago truncatula; identical to SEQ ID NO: 592

SEQ ID NO: 601 - protein, 323 aa, Medicago truncatula; identical to SEQ ID NO: 593

SEQ ID NO: 602 - DNA, 1020 bp, Medicago truncatula
atggacccagtttccgacccaccatttgaagaagcatataagatcctcctgaacaaaaccaaaaacaatcgtaataatgtccccaacgacaacaagtttccggtggtggaggaatgcgaacttccggtgatcgatctgagccgcttagaggacgacaatgaaatggtaagagaagcatgcaagtatgagatagctagagcttcgcaagaatggggctttttccaggttataaatcatggaattccaaatgacattttcagtaggttaaaatgtgagcaagagaaagtttttaagcttccatttgataaaaagaccaaagaggacaagttcttgcaattttcttctggtagttaccgttggggaacaccttctgccacatgtgttggacagttatcttggtcagaggcatttcatatccctttaaaggatgtattagaatccaatgctcaaccaaatacacttagatcaacaattgaacaatttgctatcatatcatccaaccttgcacaaactttagctcatattctagctgaaaaaatggggcatgaatcaacttattttaaggagaattgcttgcccaatacttgttatcttcgattgaacagatatcctccatgtcctatagcttctgagattcatggtctaatgccacacactgatagtgacttcctaactatattgtatcaagatcaagtaggaggattgcaattggtgaaagacaagaaatggattgcagttaaaccaaatcctagtgctcttataatcaacataggtgacttattccaggcttggagtaatggactttacaagagtgttgagcatcgagttgttacaaatccaaaagttgaaaggttctctatggcgtatttcttgtgcccttcaaatgagagtgtgatagagagctgcaaaaagccatctctttacaaagagtttagcttccaagaatatcggcaacaagttcgagatgatgttcagaagttggggaccaaaataggcctacctagatttctcctattttaa

SEQ ID NO: 603 - protein, 339 aa, Medicago truncatula
MDPVSDPPFEEAYKILLNKTKNNRNNVPNDNKFPVVEECELPVIDLSRLEDDNEMVREACKYEIARASQEWGFFQVINHGIPNDIFSRLKCEQEKVFKLPFDKKTKEDKFLQFSSGSYRWGTPSATCVGQLSWSEAFHIPLKDVLESNAQPNTLRSTIEQFAIISSNLAQTLAHILAEKMGHESTYFKENCLPNTCYLRLNRYPPCPIASEIHGLMPHTDSDFLTILYQDQVGGLQLVKDKKWIAVKPNPSALIINIGDLFQAWSNGLYKSVEHRVVTNPKVERFSMAYFLCPSNESVIESCKKPSLYKEFSFQEYRQQVRDDVQKLGTKIGLPRFLLF

SEQ ID NO: 604 - DNA, 1020 bp, Medicago truncatula; identical to SEQ ID NO: 602

SEQ ID NO: 605 - protein, 339 aa, Medicago truncatula; identical to SEQ ID NO: 603

SEQ ID NO: 606 - DNA, 1014 bp, Medicago truncatula
atggttgtattgtccaaaacaagtttagagcaatatccatgtataagaaacttgaaacaaaccatattttcaactgaaatccctatggtggatctttccaaacccgatgcaaaaaaccttatagtaaaagcatgtgaagagtttggattctttaaggtgataaaccatggtgtttctatgaaatgtatatctttgttagaatctgaagctgttaagtttttttctatgtctattgatcaaaaggagaaagcaggaccagctaatccatttgggtatggtaacaagaaaattggacaaaatggtgatattggttgggttgaatatcttcttcttaccaataatcaagattttaaccaattcaaactttcccctgcttttggtaaagattcagataagcttcgctgtttattgagtgagtatatgtcaagtgtgaaaaagatgggatgtgagattcttgaattgatggcctcaggattgaatattgaagaaaataatgtatttagcaagcttctaatggataaagagagtgattgcattttcaggcttaatcattatcctccttgtcctcctaagtcaaatttgaataataatgaaaatgaaaatgtgattggttttggtgagcacacagatccacaaataatttcattgttgaggtcaaataacacttctggtcttcaaattcgtctcaaagataagagttggatttcagtcccttctgatcacaattccttctttgttaatgtcggtgattctcttcaggttatgactaatggacgattcaagagtgtgaggcacagagttttagcaaatgggttcaaatctagactctccatgatttattttggtggtccatctttgaatgagaaaattgcacctttgccttgtctcataaaaggaaatgaatgcttattatatagagagtttacatggtttgaatacaagaaatcagcttatgctacaagattatcagacaataggctttgtcactttgagagaatcaaagattcctcctaa

SEQ ID NO: 607 - protein, 337 aa, Medicago truncatula
MVVLSKTSLEQYPCIRNLKQTIFSTEIPMVDLSKPDAKNLIVKACEEFGFFKVINHGVSMKCISLLESEAVKFFSMSIDQKEKAGPANPFGYGNKKIGQNGDIGWVEYLLLTNNQDFNQFKLSPAFGKDSDKLRCLLSEYMSSVKKMGCEILELMASGLNIEENNVFSKLLMDKESDCIFRLNHYPPCPPKSNLNNNENENVIGFGEHTDPQIISLLRSNNTSGLQIRLKDKSWISVPSDHNSFFVNVGDSLQVMTNGRFKSVRHRVLANGFKSRLSMIYFGGPSLNEKIAPLPCLIKGNECLLYREFTWFEYKKSAYATRLSDNRLCHFERIKDSS

SEQ ID NO: 608 - DNA, 1092 bp, Paris sp.
atgcgagaggtctccagcattttacatacttcatgctatcttctactcccatctgcagaacacctctcctgtttttgctctgttttcggtgcaaaaatcatggtgatattctccaaggccgagctcgatcagatatccctcccaaattctcatgagtccatctacaacttccccgccgtggatctttcggagccgggtgctgggtctcggattgtcaaggcctgtgaggagctcggattcttcaaggtcaccagacatgggatccccactgagcttgtggagaggttggaggctgaggctgtgaagttctttgggatgccacagatggagaaggagaaggctaccctttgtggttatgggagaagaaggatagggtgtaatggggatgtggggaggttggagtacctcatggttcagatcacctccgatcccatgtctctcgaatcattcgccttccttgcagaaccgtcagcgagcttcttccgctctgctttggaggagtatgtatcagctgtgaggaagttggcttgccaaattctggagttgatggctgaagggctttctatcgagccaagaaatacgctgagcaagttggcaatgaacgaggagagcgactcagcttttaggctcaatcactaccctctttgcccgatcctcaaccgcatggatcgagtcccgatcgatttcggcgagcacacggacccacaaatcatatcggccttgagatccaacaacacttcgggtttgcagatatcactgagggatgatgggagctgggtctcagtcccgcctgaccgaaactcattcttcatcaatgttggtgattctctgcaagttttgacgaatggtcgattcagaagcgtgaagcatagggttttggccaatagggtggagccaaggctctccatgatctacttcgtcggccctccatccagagagaggttggtaccattgccgtccctgataaaagagggggagcagagcctctacagagagttcacatggtgcgagtacaagagattggcctacagaacgagattggctgagaataggctcggacgtttcgagaagcagagaggtgtccactgttga

SEQ ID NO: 609 - protein, 363 aa, Paris sp.
MREVSSILHTSCYLLLPSAEHLSCFCSVFGAKIMVIFSKAELDQISLPNSHESIYNFPAVDLSEPGAGSRIVKACEELGFFKVTRHGIPTELVERLEAEAVKFFGMPQMEKEKATLCGYGRRRIGCNGDVGRLEYLMVQITSDPMSLESFAFLAEPSASFFRSALEEYVSAVRKLACQILELMAEGLSIEPRNTLSKLAMNEESDSAFRLNHYPLCPILNRMDRVPIDFGEHTDPQIISALRSNNTSGLQISLRDDGSWVSVPPDRNSFFINVGDSLQVLTNGRFRSVKHRVLANRVEPRLSMIYFVGPPSRERLVPLPSLIKEGEQSLYREFTWCEYKRLAYRTRLAENRLGRFEKQRGVHC

SEQ ID NO: 610 - DNA, 1032 bp, Paris sp.
atggttgtggcatctccgatgccagggtgcaacgagagggtgctcggcctcggaattccgctgatcgacctctcgtggaggagggagcgggcgtcaaagctcatcgttaaggcaagcgagaagttcggattcttcagagtgatcaaccacggcgtgccaaagggggtggtagccaggatggaggccgaagcgatagaattcttctcgatgtcggcccaagagaagcaaaactccgggcccccgagcccgctaggctacgggataaggaacatcgggctcaaaggcgataccggggagctcgagtacctcatcctccacgccaaccctacctccgtcgccccgtgggcgaggacagtatgccggaaggacccgatgaaatttagctctatagtgaacgaatatgtggaggggacgagggggttagcatgcgacatactagaaatgatgggcgaagagctgcgactggatgatcgaagggctctcagtaaactaataagggacgacgagaatgattcgctcatcaggttcaaccattacggccctcattgttgcagcagtaataagaacggaaagagcccaaggatcggttttggggagcactcagaccctcagatactcagtatattacgatctaatggcgtcgaggggctgcagatactaatgtcttctgacgatggagatgtatggatccccgtgcccgcggaccctgatgccttctttgtcatcgtaggtgatgtcctccaggctttgactaatgggaggcttttgagtgtgaggcatcgagccatgtccaactccaactgctcaaggctttccatgatctacttcggtgcaccgacactccacacgatgatctctccactccccgagatggtctcattggagactccgtgtcgctatcgatcattcacatgggctgactacaagaaggcaatgtactcgcttcgactcacccacaatcgtctcgatctcttcctaatcaacattgcacaagacatcagtccattcgaaagaatacttcagattttgtga

SEQ ID NO: 611 - protein, 343 aa, Paris sp.
MVVASPMPGCNERVLGLGIPLIDLSWRRERASKLIVKASEKFGFFRVINHGVPKGVVARMEAEAIEFFSMSAQEKQNSGPPSPLGYGIRNIGLKGDTGELEYLILHANPTSVAPWARTVCRKDPMKFSSIVNEYVEGTRGLACDILEMMGEELRLDDRRALSKLIRDDENDSLIRFNHYGPHCCSSNKNGKSPRIGFGEHSDPQILSILRSNGVEGLQILMSSDDGDVWIPVPADPDAFFVIVGDVLQALTNGRLLSVRHRAMSNSNCSRLSMIYFGAPTLHTMISPLPEMVSLETPCRYRSFTWADYKKAMYSLRLTHNRLDLFLINIAQDISPFERILQIL

SEQ ID NO: 612 - DNA, 978 bp, Paris sp.
atgacggattcaaatccaccgctcttcagcaagtacaaggccctcctcgacatccggccgtcgatcgactatccgacggctgtggccgatgagtgcaacctccccctcatcgacctcagctccctgaggaccgacaaagcccgagcatgcaagagggcgatcgcagtagcggcgtccgagtggggtttctttcagttggtgaatcatgggatctcgcgagagctacaagacaggatacgagccgtgcaagttgatatttttcagcacccatttgcttggaagacgaccgagaggctgctcgacttctcgaatggcagctaccggtgggggacaccgacggccacttcgctgccacagttgtcgtggtcggaggcttaccatcttcccctcacaccttcagctgtggaagctaaagatagcacgaggcacacaatagaggagtttgcagtggcaatgtcaaggttggctcaccaactagcccaaatactagcagaagaattggggtacgagggtggctacttcaaggagagctgcaactgcgacacatgctaccttcggctgaatcactacccaccatgcgcggtgtcgggtcaggtgtttgggctaacccaacacaccgatagcgacttcctgaccgtccttttccaggatcaagttggtggcctccaactcatgaagggtgggagatggaactccgtgaagccaaatctcgatgctctgatcatcaacattggtgacttatttcaggcgtggagtaacggggtgtacaagagcgtggagcacagagtcgtggcgaatcccaagttagagagattctcagttgcgtactttctatgcccatcgtacgataccatggtccagagctatgcaaatccatcaatctacaaaacattcaccttcggagaatacaggcaaaaggtgatggaagatgttaaactgataggcaccaaggttggacttccaaggtttcttgcatga

SEQ ID NO: 613 - protein, 325 aa, Paris sp.
MTDSNPPLFSKYKALLDIRPSIDYPTAVADECNLPLIDLSSLRTDKARACKRAIAVAASEWGFFQLVNHGISRELQDRIRAVQVDIFQHPFAWKTTERLLDFSNGSYRWGTPTATSLPQLSWSEAYHLPLTPSAVEAKDSTRHTIEEFAVAMSRLAHQLAQILAEELGYEGGYFKESCNCDTCYLRLNHYPPCAVSGQVFGLTQHTDSDFLTVLFQDQVGGLQLMKGGRWNSVKPNLDALIINIGDLFQAWSNGVYKSVEHRVVANPKLERFSVAYFLCPSYDTMVQSYANPSIYKTFTFGEYRQKVMEDVKLIGTKVGLPRFLA

SEQ ID NO: 614 - DNA, 969 bp, Paris sp.
atggactccactgcggacccgtcctacccgcacattttccggcggcacgaatcggaccatgaaccggactgtgaaccgtaccgcaaggccggtccggaaatcccggtggtagacctgagagcgctggaccccggccggctcgccgaagcgtgcagagtgtgggggatttttcggctcgccaaccacgggattcccccgaccctctccaaccgaattctggaccgggctcggttgatcctatccgaacccttcgaggataagcggacccggttcggaggcggcccggtctcctacttctggggaaccccggccgtcgggaagcgggtgaggtccgtcaactgggtggaaggcctccacatccccctcgcccgtctccgctccggcgaggagcccgggtttggatcctcttcttttaggtgtttggtggatgaatatgtgcggcacatggcccggatcgcaagggagctcttcaatgcactgacggtcgatctcaaactggactctgtccaatcgacttcacacttctctgaacctgatgcgattctccgagtctatcgatacccacgccgcccaaatgcttgccacaatttcgggttggaagcccacagtgatagctccctcctatccatcttgaatcaagacgaggtcggagggctgcagatccttcgtgagggacggtggatcaatgttgcaccaatctccgacatgctcatcgtaaacatcggcgacatgatgcaggccattagtgataacgagtacatgagcgtggaacacagggtactggcgagctcgagcaaggaaaggatctcattgtgctacttcgcttacccatccgaagatggcttgatcagtagctcaagatacaagccatttacttacaaggatttcaaagccaaggtgcaggaggatatcgaggcaactggcttcaagattgggctcgaccggtttaggattactgatccaaactaa

SEQ ID NO: 615 - protein, 322 aa, Paris sp.
MDSTADPSYPHIFRRHESDHEPDCEPYRKAGPEIPVVDLRALDPGRLAEACRVWGIFRLANHGIPPTLSNRILDRARLILSEPFEDKRTRFGGGPVSYFWGTPAVGKRVRSVNWVEGLHIPLARLRSGEEPGFGSSSFRCLVDEYVRHMARIARELFNALTVDLKLDSVQSTSHFSEPDAILRVYRYPRRPNACHNFGLEAHSDSSLLSILNQDEVGGLQILREGRWINVAPISDMLIVNIGDMMQAISDNEYMSVEHRVLASSSKERISLCYFAYPSEDGLISSSRYKPFTYKDFKAKVQEDIEATGFKIGLDRFRITDPN

SEQ ID NO: 616 - DNA, 984 bp, Phaseolus vulgaris
atggtattgttgtccaaaacaacaacagagcaattctcctacatcaagaactgcatggcatccacattctcctccacaattcccatagtggacctttccaaacctgatgcaaagaccctcatagtgaaagcttgtgaggagtttggattcttcaaagtcatcaaccatggtgtccccatggaacctatatcacaattggaaactgaaaccctcaagttcttctctatgccactcaatgagaaggaaaaagcagggcctcccaacccatttgggtatggtagcaagaggattggacgcaatggtgatgttggctgggttgagtatcttcttctaaacaccaatcaagagcacggtttttctcccagtggcaaaaacgctgagaaactcaggggtctgttgactagttacatgtctcttgtgaagaaaatggcttgtgatattcttgagctgatggcagaagggttgaagattcagcagaagaatgtgttcagcaagcttctgatggataaacagagtgactctgttttcagggtgaatcattaccctgcttgccctgaacttgctgtgaatggtcagaacatgattgggtttggagaacacacagacccacaaataatctctctgctcaggtctaacaacacttcaggccttcagatttatctcagagatggaagttggattccagtcccacctgatcacaactccttcttcatcaatgttggagattctcttcaggttatgactaatggacggttccggagtgtgagacacagggttttggcaaacggattcaagtcgaggctctcaatgatttactttggaggtccacctttgagtgagaaaatagcaccattaccttctctcatcaaaggaaaacaaagcctatacaatgagtttacgtggtttgagtacaagaattcaacctatggttcaaaattggctgacaatagacttggacattttgagagaattgcagcttcataa

SEQ ID NO: 617 - protein, 327 aa, Phaseolus vulgaris
MVLLSKTTTEQFSYIKNCMASTFSSTIPIVDLSKPDAKTLIVKACEEFGFFKVINHGVPMEPISQLETETLKFFSMPLNEKEKAGPPNPFGYGSKRIGRNGDVGWVEYLLLNTNQEHGFSPSGKNAEKLRGLLTSYMSLVKKMACDILELMAEGLKIQQKNVFSKLLMDKQSDSVFRVNHYPACPELAVNGQNMIGFGEHTDPQIISLLRSNNTSGLQIYLRDGSWIPVPPDHNSFFINVGDSLQVMTNGRFRSVRHRVLANGFKSRLSMIYFGGPPLSEKIAPLPSLIKGKQSLYNEFTWFEYKNSTYGSKLADNRLGHFERIAAS

SEQ ID NO: 618 - DNA, 1029 bp, Phaseolus vulgaris
atggttgttctttctaaccaatctgcactgaacgagttgtttctggccaagacatgcaatccccccaccatgttcacggaggttcccgtggttgatctctcacgccctgatgccaaaacaatcatggtgaaggcctgccaagagattggtctcttcaaggtggtcaaccatggcattcccttggaggtgataacgcgtttggagaatgaagcgctcaagttcttcatgcaaagccagtcacacaaagacaaggccggtcctcccgaccctttcggctatggcagcaagagaattggcacaaacggtgacctgggttgggtcgagtatctcctcctcagcaccaaccctgacatcgtctcccccaaaactcttcagctttttcaccaaaacccgcaagttttcaggttgtgtgtggaggaatacataggggcagtgaagaagatgtgctgtgaagtgttggaagaaatgggtgaggggttggggatgggagaaaggaatgtgtttagcagaatgataagagaggagagaagcgattcatgcttgagggtgaataggtacccagcatgtccagagctgaaagaggaaggtgcactgagtggacgaaatttgattgggtttggagagcacacagacccacagatattatctgtcctcagatccaacaacacatcaggactgcaaatctgtctcccagatgggacttgggtttcaatcccccctgacccttcctccttttttgtcaatgttggtgacctcttgcaggttatgacaaatgggaggtttaggagtgttaagcacagggtgttggctgactcaagcttgtcaaggttgtcaatgatatattttggagggccatgtttggacgaaaagattggtcctttaccttcactggtgtcaagggaagaagagaatttgtacagagagttgacatggcgggaatacaagaatgctgcatacaagacaaggctctctgatgataggatcactctctttcaaaaatctgcagatcacactcacaaacagacttga

SEQ ID NO: 619 - protein, 342 aa, Phaseolus vulgaris
MVVLSNQSALNELFLAKTCNPPTMFTEVPVVDLSRPDAKTIMVKACQEIGLFKVVNHGIPLEVITRLENEALKFFMQSQSHKDKAGPPDPFGYGSKRIGTNGDLGWVEYLLLSTNPDIVSPKTLQLFHQNPQVFRLCVEEYIGAVKKMCCEVLEEMGEGLGMGERNVFSRMIREERSDSCLRVNRYPACPELKEEGALSGRNLIGFGEHTDPQILSVLRSNNTSGLQICLPDGTWVSIPPDPSSFFVNVGDLLQVMTNGRFRSVKHRVLADSSLSRLSMIYFGGPCLDEKIGPLPSLVSREEENLYRELTWREYKNAAYKTRLSDDRITLFQKSADHTHKQT

SEQ ID NO: 620 - DNA, 927 bp, Phaseolus vulgaris
atggcatccacatcctccttcacaattcccatagtggacctttccaaacctgatgcaaagagcctcatagtgaaagcttgtgaggagtttggattcttcaaagtcatcaaccatggtgtcccaatggaatctatatcacaattggaaactgaggccctcaagttcttctctatgtcaatcaatgagaaggaaaaagcagggcctccaaatccatttgggtatggtagcaagaggattggacaaaatggtgatgttggttgggttgagtatcttcttctaaacaccaacgaagagcacgatttttctctctgtgggaaaaaccctgagaatttcaggggtctgttgaatagttacacgtctcttgtgaagaaaatggcttgtggtattcttgagctgatggcagaagggttgaagattcagcagaggaatgtgttcagcaagcttttgatggatgaacagagtgactctatttttagggtgaatcattaccctgcttgccctgaacttgctgtgaatggtgagaacttgattgggtttggagaacacacagacccacaaataatctctctgctaaggtctaacaacacttcaggcctccagatttatctgagagatggaagctggatttcagtcccacctgatcacaactccttcttcatcaatgttggagattctcttcaggttatgactaatggacgattccggagtgtgaggcacagggttttggcaaatggattcaagtcgaggctctcaatgatttactttggaggtccacctttgagtgagaaaatagcaccattaccttctctcatcaaaggaaaccaaagcctatacaatgagtttacctggtttgagtacaagaattcaacttatggttcaaaattggctgataatagacttggacattttgagagaattgcagcttaa

SEQ ID NO: 621 - protein, 308 aa, Phaseolus vulgaris
MASTSSFTIPIVDLSKPDAKSLIVKACEEFGFFKVINHGVPMESISQLETEALKFFSMSINEKEKAGPPNPFGYGSKRIGQNGDVGWVEYLLLNTNEEHDFSLCGKNPENFRGLLNSYTSLVKKMACGILELMAEGLKIQQRNVFSKLLMDEQSDSIFRVNHYPACPELAVNGENLIGFGEHTDPQIISLLRSNNTSGLQIYLRDGSWISVPPDHNSFFINVGDSLQVMTNGRFRSVRHRVLANGFKSRLSMIYFGGPPLSEKIAPLPSLIKGNQSLYNEFTWFEYKNSTYGSKLADNRLGHFERIAA

SEQ ID NO: 622 - DNA, 996 bp, Phaseolus vulgaris
atggtgctggctgccccaatcccaataaggagcgatgggattctccccagtgagcttcccgtggtggacctctcaggcgagagggcggaagtggcaaaagtgatcgtgaaagcgtgtgaagaatacggtttcttcaaagtgataaaccacggtatcagcaaggaagttatagcgaaaactgaagaagcagggttcggtttctttgggaaagcgatggtggaaaagaaagtggcggcacctgcatatgggtgcaagaacataggtgtcaatggagacatgggtgaggtggagtaccttctcctcagtgccaccaccgactccattgctcacatttccaaaaccatatccactgacccattaaatctcagcaatagcttgagtgcatacacagaagcagtgaaagagctagcatgtgagatattggaggtgatggcagaggggctgggggtcccggacacttgggttttcagcagattgataagggatggtgaaagtgactcagtgctgaggctcaatcactacccacctataattaacagagagtggtgcatggagaaggacaaagataaggacaagtcatcacaaattagcaaggttgggtttggggagcattctgaccctcagatcctcaccattctcagatccaacgacgtgggaggcctacaaatttctcttccagatggggtgtggatcccagtcacccctgacccctctgcattctatgtgaatgtgggtgatgtactacaggttatgacaaatggaagatttgtgagcgtgagacacagggcaatgacgaactcatacaagtgtagaatgtcagtggcatattttggggctccacctctgcatgcaaccattgttgctccctcagttatggtcacacctcagaggccctctctcttcagacccttcacttgggccgaatacaagaaagccacatactctctcaagcttggagacacacgccttcagcttttcagaaactgcaaacgctga

SEQ ID NO: 623 - protein, 331 aa, Phaseolus vulgaris
MVLAAPIPIRSDGILPSELPVVDLSGERAEVAKVIVKACEEYGFFKVINHGISKEVIAKTEEAGFGFFGKAMVEKKVAAPAYGCKNIGVNGDMGEVEYLLLSATTDSIAHISKTISTDPLNLSNSLSAYTEAVKELACEILEVMAEGLGVPDTWVFSRLIRDGESDSVLRLNHYPPIINREWCMEKDKDKDKSSQISKVGFGEHSDPQILTILRSNDVGGLQISLPDGVWIPVTPDPSAFYVNVGDVLQVMTNGRFVSVRHRAMTNSYKCRMSVAYFGAPPLHATIVAPSVMVTPQRPSLFRPFTWAEYKKATYSLKLGDTRLQLFRNCKR

SEQ ID NO: 624 - DNA, 972 bp, Phaseolus vulgaris
atggtggttataaggagtgaaaagattttacccattcatcttcccgttgtggacttatccacagaaagatcaatggtgagaaaactcatagtgaaagcttgtgaggagtacggtttcttcaacgtgatcaaccatggagttccctgcgacaccatagccaaaatggaagaagcagcttttgatttctttgcgaagccactggcccaaaagaaacaacttcccctttatggctgcaagaacataggcttcaatggagacatgggagagattgagtaccttctccttagtgctactcctccctccatggctcacttcaacaacatctccaatgtgccttcaaacttcagctgtagtgtgagtgcatacacagagggagtgagggagctggcatgtgagattttggagctaatggcagagggtctgggggttccggatagatggtttttgagcaggttgatcagggaggttgatagtgactcagtcctgaggttcaatcactacccaccgatacttaacaaagactgcaaggataaggacaagtctccctcccacaaccacaccaaggttggctttggggagcattctgaccctcagatccttaccatcctcagatccaatgacgtgtgtggcctccaaatctctcttcaagatggggtgtggaacccagttgctcctgacccctcagctttctgtgttaatgtgggtgatctcttgcaggttatgacaaatggaagatttgtgagcgtgagacacagggctgtgacaaactcacacaagtctagaatgtcggtggcgtattttgggggtccaccacttgatgcatgcattgttgctccctcagttatggttacaccccagaggccctccctcttcaaacccttcacttgggctgaatacaagaaagtcacctactcaatgaggctgggagaacgccgcattgaccttttcaggaactgcactcaactcgactga

SEQ ID NO: 625 - protein, 323 aa, Phaseolus vulgaris
MVVIRSEKILPIHLPVVDLSTERSMVRKLIVKACEEYGFFNVINHGVPCDTIAKMEEAAFDFFAKPLAQKKQLPLYGCKNIGFNGDMGEIEYLLLSATPPSMAHFNNISNVPSNFSCSVSAYTEGVRELACEILELMAEGLGVPDRWFLSRLIREVDSDSVLRFNHYPPILNKDCKDKDKSPSHNHTKVGFGEHSDPQILTILRSNDVCGLQISLQDGVWNPVAPDPSAFCVNVGDLLQVMTNGRFVSVRHRAVTNSHKSRMSVAYFGGPPLDACIVAPSVMVTPQRPSLFKPFTWAEYKKVTYSMRLGERRIDLFRNCTQLD

SEQ ID NO: 626 - DNA, 999 bp, Phaseolus vulgaris
atggttgttctgtctcagccagcattgaaccagtttttccttctgaaaccattcaagtccacgcccttgttcacggggattcctgtggtcgacctcacgcaccccgatgccaagaatctcatagtgaacgcctgtagggacttcggtttcttcaagcttgtgaaccatggtgttccattggagttaatggccaatttagaaaaagaggccctcaggttctttaaaaaatctcagtccgagaaagacagagctggtccccccgaccctttcggctatggtagcaagaggattggcccaaacggtgatgtcggttgggtcgaatacctcctcctcaacaccaaccctgaggttatctcacccaaatcactttgcattttccgagaaaatcctcatcatttcagggcggtggtggagaactacattacagcagtgaagaacatgtgctatgcggtgttggaattgatggcggaggggttggggataaggcagaggaatacgttaagcaggttgctgaaggatgagaaaagtgattcgtgtttcaggttgaaccactacccgccttgccctgaggtgcaagcactgaaccggaatttggttgggtttggggagcacacagacccacagataatttctgtcttaagatctaacagcacatctggcttgcaaatctgtctcacagatggcacttgggtttcagtcccacctgatcagacttcctttttcatcaatgttggtgacgctctacaggtaatgactaatgggatgtttaaaagtgtaaagcatagggttttggctgacacaacgaagtcaaggttatcaatgatctactttggaggaccagcgttgagtgaaaagatagcacctttaccttcagtgatgttaaaaggagaggagtgtttgtacaaagagttcacatggtgtgaatacaagaaggctgcgtacacttcaaggctagctgataataggcttgcccctttccagaaatctgctgctgattaa

SEQ ID NO: 627 - protein, 332 aa, Phaseolus vulgaris
MVVLSQPALNQFFLLKPFKSTPLFTGIPVVDLTHPDAKNLIVNACRDFGFFKLVNHGVPLELMANLEKEALRFFKKSQSEKDRAGPPDPFGYGSKRIGPNGDVGWVEYLLLNTNPEVISPKSLCIFRENPHHFRAVVENYITAVKNMCYAVLELMAEGLGIRQRNTLSRLLKDEKSDSCFRLNHYPPCPEVQALNRNLVGFGEHTDPQIISVLRSNSTSGLQICLTDGTWVSVPPDQTSFFINVGDALQVMTNGMFKSVKHRVLADTTKSRLSMIYFGGPALSEKIAPLPSVMLKGEECLYKEFTWCEYKKAAYTSRLADNRLAPFQKSAAD

SEQ ID NO: 628 - DNA, 1038 bp, Phaseolus vulgaris
atggactccgtttcggacccaccctttcacgaggcatacaagatcctatttgataggaccccagagaatattaatggttctgataacgattttctggtggccgaggaatgccagcttccggtgatcgatctcagccgtttagaggagagtgatgagagtgtgagggaagagtgcaagtcacacatagctagggcttcacgggactggggtttcttccaggtcgtgaaccatggtatttccagtgatattttcagcaggttgagatgtgaacaagaaaaagttttcaggcaaccctttgagaagaagatgaaagaggacaagttcttgaacttctccgccggaagctaccgttggggaacccccactgccacatgcattagacagttatcttggtcagaagcctttcatattcctctaaccgatatactaggatcctctcgatcaaactctcttagttcgacaattgaacagtttgctacaacagtttcgagccttgcacaaacattagccgacatactggcggagaaaatgggtcacaagtcaaccttctttaaggagaattgtttggcgaacacctgctatcttcgactcaaccgatatcctccatgccctactgcttttgggattcacggtctcatgccacacactgacagtgactttctcaccatattatatcaggatcaggttggaggtttgcaattggtcaaagacacaaaatggatcgcagttaaaccaaaccccgatgcccttataatcaacattggtgacttgttccaggcatggagcaacggggtgtacaagagcgtggagcatcgcgttatgaccaacccgaaactagagaggttctctatggcgtatttcttgtgtccttcaaatgatactgtgatagagagttgcagagagccctctatttacagaaaattcagctttcgggagtatagaaaacaggttcgtgatgatgttcagaagttgggtaccaaaataggcttgcccaggtttctcacacacgaaggaagttcgaacatagcaagcgcataa

SEQ ID NO: 629 - protein, 345 aa, Phaseolus vulgaris
MDSVSDPPFHEAYKILFDRTPENINGSDNDFLVAEECQLPVIDLSRLEESDESVREECKSHIARASRDWGFFQVVNHGISSDIFSRLRCEQEKVFRQPFEKKMKEDKFLNFSAGSYRWGTPTATCIRQLSWSEAFHIPLTDILGSSRSNSLSSTIEQFATTVSSLAQTLADILAEKMGHKSTFFKENCLANTCYLRLNRYPPCPTAFGIHGLMPHTDSDFLTILYQDQVGGLQLVKDTKWIAVKPNPDALIINIGDLFQAWSNGVYKSVEHRVMTNPKLERFSMAYFLCPSNDTVIESCREPSIYRKFSFREYRKQVRDDVQKLGTKIGLPRFLTHEGSSNIASA

SEQ ID NO: 630 - DNA, 1032 bp, Phaseolus vulgaris
atggactcgaattcaaacccaccccttcacgaggcatacgatatgctcttgagcaagagccgaaacagtaacgaacagagtggttttgatgatgatgaggtgttggtggtggaggagacagagttgccagcgatcaatgtgagtcatttagcagagagtgatgaagtgaggagggaggagtgcaagtccgagatagctaaggcttctcaagaatggggtttctttcagatcgttaatcatggaatttccaatgacgttttcagtgttttgagggtcgaacgagagaagatatttaagcaaccttttgagaagaagagcaaagagaacaagctcttcaacttttccactggtagctaccgttggggagcccccactgcaacatgcattaggcagttatcttggtctgaagcattccatattcctctaactgatatactcagttccaccgattccaacacttttagctcaaccattgaagagtttgccagccaagtttctattctggcgaaaacgttggctcatatcctggctgagaaaatgggtcacaagtgtagtttctttgaggagaattgtttgcccagttcttgttatattcgattgaatcgatatcctccatgccccttggcttctgaggttcacggactgatgccacatacagacactgctttcctcaccatcttacatcaagatcaggtcagaggtttgcaaatcgtgaaagatgggaaatggattgcagtcaaaccaaaccctgatgcccttgtaatcatcattggcgacttgttccaggcatggagcaatggagtttacaaaagtcttgaacaccgagttatgacgaacccaaaattagagagattctctatggcgtatttcttttgcccctctgatgatacattgatagaaagctgcacagaggcgtcgaagtacaggaactttagctttggggaatatagacaagaagttcgagatgatgttcagaagttgggctacaaaattggcctaccaaagtttctcatacgtagaggagctacgtaa

SEQ ID NO: 631 - protein, 343 aa, Phaseolus vulgaris
MDSNSNPPLHEAYDMLLSKSRNSNEQSGFDDDEVLVVEETELPAINVSHLAESDEVRREECKSEIAKASQEWGFFQIVNHGISNDVFSVLRVEREKIFKQPFEKKSKENKLFNFSTGSYRWGAPTATCIRQLSWSEAFHIPLTDILSSTDSNTFSSTIEEFASQVSILAKTLAHILAEKMGHKCSFFEENCLPSSCYIRLNRYPPCPLASEVHGLMPHTDTAFLTILHQDQVRGLQIVKDGKWIAVKPNPDALVIIIGDLFQAWSNGVYKSLEHRVMTNPKLERFSMAYFFCPSDDTLIESCTEASKYRNFSFGEYRQEVRDDVQKLGYKIGLPKFLIRRGAT

SEQ ID NO: 632 - DNA, 999 bp, Populus trichocarpa
atggtgcttatatccaagccagctcttgaacagttctcgtttataagaaacagaaaacctaccacagttttttctggaatccctctaatagacctctcaaaacctgactccaagcacctactggttgaggcatgcgaggaatttggatttttcaaggtaatcaaccatggagtgcctatggaattcatatccaagctggaatctgaagctgtcaatttcttctcattaccgctctctgagaaagaaaaagtaggccctcctagcccctttggctatggtaacaaaagcattggacaaaatggtgatgtgggctgggtagaataccttctcttaaccactaatcaagaatcaatttctcagaggttctcttcagtttttggtgacaacccagaaaagtttcggtgtgctttaaatgattatgtatcagctgtgaagaaaatggcatgtgagattcttgaaatgatggctgatggtctaaaacttcaacaaagaaatgtgtttagtaaacttttgatggatgaacagagtgactctgtttttaggctaaatcactaccctccatgcccagaaattgaagcattgactgaccaaaacatgattggatttggagagcatacagacccacaaatcatttctgtgttaagatccaacaacacttctggcctgcaaatctctctcagtgatggcagctggatttcagttccacctgatcagaactcattttttgtcaatgttggtgactcattacaggttatgactaatgggaggtttaagagtgtcaggcacagggttttgaccaacagcatgaaagctagagtttcaatgatttattttggtggaccacctttgagtgagaaaatagctccattgccctcgctcataaaaggaaaggaaagcttgtacaaagaatttacatggttcgagtacaaaagatctgcctacagctccagattggctgataataggcttgtcctctttgagagaatagcagcctcgtaa

SEQ ID NO: 633 - protein, 332 aa, Populus trichocarpa
MVLISKPALEQFSFIRNRKPTTVFSGIPLIDLSKPDSKHLLVEACEEFGFFKVINHGVPMEFISKLESEAVNFFSLPLSEKEKVGPPSPFGYGNKSIGQNGDVGWVEYLLLTTNQESISQRFSSVFGDNPEKFRCALNDYVSAVKKMACEILEMMADGLKLQQRNVFSKLLMDEQSDSVFRLNHYPPCPEIEALTDQNMIGFGEHTDPQIISVLRSNNTSGLQISLSDGSWISVPPDQNSFFVNVGDSLQVMTNGRFKSVRHRVLTNSMKARVSMIYFGGPPLSEKIAPLPSLIKGKESLYKEFTWFEYKRSAYSSRLADNRLVLFERIAAS

SEQ ID NO: 634 - DNA, 996 bp, Populus trichocarpa
atggtagttccttctccaactccagcacgaaccaaaaaaacgaaggcctttggaattcctactgttgatctctctcttgataggtcaaacgtatcgaaactgatcgtaagggcatgtgaagaatatggattcttcaaagttacgaatcatggggtcagtaaggaggtcgtaaccagaatggaggaggaagctgctcattttttctcaaaaccagccacggaaaagcaccgagctggacctgctagtccttttggctatggttgcaaaaatattggctgcaatggtgacatgggcgagcttgaatatcttctcctccacgccaatcctctctccgtctttgaaagatccaaaaccatctcaaatgacccttcagaattcagctgcgtggtgaatgattacatacaagcggttaagcaactggcgtgtgagattcttgatctaacggctgagggcttgtgggtcccggataaacgtgcattcagcaggctcatcagagatgtccacagcgattctgttcttagacttaatcactaccctgcattcgaagagatcatggactgggacccatcacctaaaacaattggttttggcgagcactccgaccctcaaatcttgaccatcttgcgatccaacgacgttgggggcctccaaatttatttgcgtgatggcttgtgggtccctgttcctcctgaccccaccggattctatgtgatcgtgggggatgccttccaggttttaacgaatgggaggtttgaaagcgttagacacagagtgttggcgagctcggggaagccaagaatgtcaatgatgtactttggggcgccaccgcttaacgcatggatctctccgcctccacagctggtcttgccacaaaatccaagcctctacaaacccttcacttggagtgaattcaagaaagctgcctattctctgcgattgagagatacgcgtcttgacctcttcaagattcatgccacagaaaaatttgcttcttga

SEQ ID NO: 635 - protein, 331 aa, Populus trichocarpa
MVVPSPTPARTKKTKAFGIPTVDLSLDRSNVSKLIVRACEEYGFFKVTNHGVSKEVVTRMEEEAAHFFSKPATEKHRAGPASPFGYGCKNIGCNGDMGELEYLLLHANPLSVFERSKTISNDPSEFSCVVNDYIQAVKQLACEILDLTAEGLWVPDKRAFSRLIRDVHSDSVLRLNHYPAFEEIMDWDPSPKTIGFGEHSDPQILTILRSNDVGGLQIYLRDGLWVPVPPDPTGFYVIVGDAFQVLTNGRFESVRHRVLASSGKPRMSMMYFGAPPLNAWISPPPQLVLPQNPSLYKPFTWSEFKKAAYSLRLRDTRLDLFKIHATEKFAS

SEQ ID NO: 636 - DNA, 999 bp, Populus trichocarpa
atggtagtactttcccaactagctctagaacctttctcagttatcaaaacatgcaagcctataggcttgttttccgagatacccgttatagacttgacagaccctcatgccaagactctcataatcaaggcctgtgaagagtttggattcttcaagctggtaaatcatggagttccaatggaagtcatgaccaaattggaagctcttgctaccaacttctttaacctcccccagcctgagaaagacaaggctggacctcctaacccttttggctacggaaacaagaaaattggccctaatggtgatgttggttgggttgaatatctcctccttaacaccaaccctcaaatctcctcccaaaaaacgtccatttttcaggaaaacccacagattttccgctctgctgttgaagattacatactggcagtgaagagaatggcttttgaagtattggaattgatggctgatgggctggagattgagtcaaggaatgtgttcagtaggctgttgagggatgataagagtgattcatgtttcaggctaaaccactacccaccatgctcagagctgcaagcattgagtggtggaaatttgattgggtttggcgagcacacagacccacagataatatctgttctaagatctaacaacacaagtggcctgcaaatttgtctgaaagagggaacttgggtttcagtcccccctgatcagacctcttttttcatcaatgttggtgatgccttgcaggtgatgacaaatggaaggtttaggagtgtcaagcacagggttttggctgatcccctgaaaccaaggatttccatgattttcttcggtggtccacctttaagtgaaaagatagcacctttaccctccttgatggcagaaagaggaggaagcttatacaaggagttcacatggtttgaatacaaaaggtccgcatacaagtcaaggctagctgattacagacttgggctatttgagaaaactgcaggccaatga

SEQ ID NO: 637 - protein, 332 aa, Populus trichocarpa
MVVLSQLALEPFSVIKTCKPIGLFSEIPVIDLTDPHAKTLIIKACEEFGFFKLVNHGVPMEVMTKLEALATNFFNLPQPEKDKAGPPNPFGYGNKKIGPNGDVGWVEYLLLNTNPQISSQKTSIFQENPQIFRSAVEDYILAVKRMAFEVLELMADGLEIESRNVFSRLLRDDKSDSCFRLNHYPPCSELQALSGGNLIGFGEHTDPQIISVLRSNNTSGLQICLKEGTWVSVPPDQTSFFINVGDALQVMTNGRFRSVKHRVLADPLKPRISMIFFGGPPLSEKIAPLPSLMAERGGSLYKEFTWFEYKRSAYKSRLADYRLGLFEKTAGQ

SEQ ID NO: 638 - DNA, 1005 bp, Populus trichocarpa
atggtagtggcatctccaactaaacttcacagtgaagaacacctggccattgagcttcctacagtagacctctcaggagatagatcaatggtttccaatctcattgtcaaagcctgtgaggaatatggtttcttcaaggtgaaaaaccatggtgttcctcatgacatcattgcccaaatggagaaagaaagtttcaacttctttgccaaaccattcgatgaaaagcaaaaggttgagccggccaaaccctttggttatggctgcaaaaatattggcttcaatggtgatatgggagaggtggaatatctacttcttaatatcaaccctctctccatagctgaaaggtccaaaaccatctccaatgaccctgcaaaattcagctccgctgtgagtgcttacatagaagcagttagggagctggcatgtgagttattagatctgatggcggaggggctgcgggtcccggatagatcagtgtttagtaggctaatcagagatgttgacagtgactccctcatcaggttaaaccactacccccctatgcctctgctctgcaaggatgaggactcgtcaccttgtaaccaaaacaaggtagggttcggagagcattctgaccctcagatcttgaccatcttgagatccaacgatgtgggtggccttcagatttccttaaatgatggtgcgtgggtcccagtaacacctgatcccgctaccttctgggttaatgtgggtgacttgttacaggcaatgacaaatgggagatttgtaagtgtgaggcacaaagccctaaccaactcttccaagtctagaatgtcaatggcctattttgctggccctccacccaatgcgaggatcactgttccaccagaaatgattacccccaccaagccggcattatacaagccctttacctgggctgaattcaagaaagctgcttatgctatgcgacttggagatagacgccttggtctattcaggatggaaggagacgagcaagttgcttga

SEQ ID NO: 639 - protein, 334 aa, Populus trichocarpa
MVVASPTKLHSEEHLAIELPTVDLSGDRSMVSNLIVKACEEYGFFKVKNHGVPHDIIAQMEKESFNFFAKPFDEKQKVEPAKPFGYGCKNIGFNGDMGEVEYLLLNINPLSIAERSKTISNDPAKFSSAVSAYIEAVRELACELLDLMAEGLRVPDRSVFSRLIRDVDSDSLIRLNHYPPMPLLCKDEDSSPCNQNKVGFGEHSDPQILTILRSNDVGGLQISLNDGAWVPVTPDPATFWVNVGDLLQAMTNGRFVSVRHKALTNSSKSRMSMAYFAGPPPNARITVPPEMITPTKPALYKPFTWAEFKKAAYAMRLGDRRLGLFRMEGDEQVA

SEQ ID NO: 640 - DNA, 1209 bp, Populus trichocarpa
atgattctctctctcctatatatctatagcaacttagcaagcatgagcaggcacctcaccgtttctcacctccttctttccagtctctccatctctcaaaatattcctctgtcacctcttctcttctatatcttccaagtgctcctcttccttgttttagtttcctttatcttgtgtctccgaagatatataattatagacatggtagtggcatccccaactcaaattcacggggaaaaactcctggccattgagcttcctgtaatagatctctcaggcgagagatcaatggtgtccagtctcattgtcaaagcctgtgaagaatatggttttttcaaggtaaaaaaccatggcgttcctcatgacatcattgccaaaatggaaaacgaaagtttcaacttctttgccaaaacattcgatgaaaagcaaaaggctgggcttgataattcctttggttatggctgcaaaaacattggctttaatggtgatacaggagaggttgaatatctgctttgtaataccaatcctctctccattgctgaaagatccaaaaccatctccaatgaccctacagaattcagctctgcaatgagcggctacatagaagcagttagggagctggcatgtgagttattagatctgatggcagagggattgtgggtcccagatagatcagtgttcagtcgactaatcagagatgatgacagtgactcaatcatcaggttaaatcactaccctgccatgcctatactctgcaaggataaggactcctcatcaccttgtaaccacaacaaggtaggatttggagagcattctgaccctcagatcttgaccatcttaagatccaacgacgtgggtggccttcagatttccctgaatgatggtgcctgggttccagtaacacctgaccccactgccttctgtgttaatgtgggtgacttgttacaggcaatgacaaatgggagatttgtaagtgtgaggcacaaagccctaaccaactcatacaagtctagaatgtcaatggcctattttgctgcacccccacttaatgcaaggatcgctgttccaccagaaatggttacacccatcaagcctgccttatacaggcctttctcctgggctgaattcaagaatgctgcttttgctctgcgacttggagatagccgccttggtctattcatgctggaagtagatgaccaagttgcttga

SEQ ID NO: 641 - protein, 402 aa, Populus trichocarpa
MILSLLYIYSNLASMSRHLTVSHLLLSSLSISQNIPLSPLLFYIFQVLLFLVLVSFILCLRRYIIIDMVVASPTQIHGEKLLAIELPVIDLSGERSMVSSLIVKACEEYGFFKVKNHGVPHDIIAKMENESFNFFAKTFDEKQKAGLDNSFGYGCKNIGFNGDTGEVEYLLCNTNPLSIAERSKTISNDPTEFSSAMSGYIEAVRELACELLDLMAEGLWVPDRSVFSRLIRDDDSDSIIRLNHYPAMPILCKDKDSSSPCNHNKVGFGEHSDPQILTILRSNDVGGLQISLNDGAWVPVTPDPTAFCVNVGDLLQAMTNGRFVSVRHKALTNSYKSRMSMAYFAAPPLNARIAVPPEMVTPIKPALYRPFSWAEFKNAAFALRLGDSRLGLFMLEVDDQVA

SEQ ID NO: 642 - DNA, 1107 bp, Populus trichocarpa
atggttgtgtgtgtgtttgtgtatattataagtagcatttttgtatatcaactcagccgagctctctctatctctctgtcttctttcctcctgcagacaacaacaaccatggtgctcgtgcccaagccagcacttcaacagttctcgtttataagaaacatcaaacccaccacattcttttctggaatccctctaatagacctctcaaaacccgactccaagcacctcctggtcaaggcatgtgaggaatttggatttttcaaggtagtcaaccatggcgtgcctttggaattcatttcgaagctggaatcggaagctgtcaagttcttctcattaccgctttctgagaaagaaaaagcaagccctcctaatccctttggctatggtaagaaaagcattggacaaaacggtgatgtgggttgggtagaataccttctcctgaccactaatcaagaatcagtttctcagagactctcttcagtttttggtgacaacccagaaaagtttcggtgtgctttgaatgattatgtatcagctgtgaagaaaatggcatgtgagattcttgaaatgatggctgatggtctaaagattcagaatagaaatgtgtttagtaaacttttgatggatgaacagagtgactctgtttttaggctaaatcactaccctccatgcccagagattcaagcattgaaagaccacaacatgattggatttggagagcacacagacccacagatcatttctgtgttaagatccaacaacacttctggcctgcaaatctctcttaatgatggaagctggatttcagtcccacctgacccgagctcatttttcatcaatgttggcgactcattacaggttatgactaatgggcggtttaaaagtgtaaggcacagagtcttggccaacagtataaaggctagaatttcaatgatttattttggtggaccacctttgagagagaaaatagctccattgccctcgctcatggaaggagaagaaagcttgtacagagaatttacatggttcgagtacaagagatctgcttacaactcaagattggccgataataagcttgtcctcttcgagaggataacagcctcgtaa

SEQ ID NO: 643 - protein, 368 aa, Populus trichocarpa
MVVCVFVYIISSIFVYQLSRALSISLSSFLLQTTTTMVLVPKPALQQFSFIRNIKPTTFFSGIPLIDLSKPDSKHLLVKACEEFGFFKVVNHGVPLEFISKLESEAVKFFSLPLSEKEKASPPNPFGYGKKSIGQNGDVGWVEYLLLTTNQESVSQRLSSVFGDNPEKFRCALNDYVSAVKKMACEILEMMADGLKIQNRNVFSKLLMDEQSDSVFRLNHYPPCPEIQALKDHNMIGFGEHTDPQIISVLRSNNTSGLQISLNDGSWISVPPDPSSFFINVGDSLQVMTNGRFKSVRHRVLANSIKARISMIYFGGPPLREKIAPLPSLMEGEESLYREFTWFEYKRSAYNSRLADNKLVLFERITAS

SEQ ID NO: 644 - DNA, 999 bp, Populus trichocarpa
atggtagttccttctccaacaccaatacgaaccaaaacgacgaaggctttaggaattcctactgttgatctttctcttgacaactcgagcgtatcacagttgatcgtaagagcatgcgaagaatatggattcttcaaagttataaatcatggggtcaacaaggaggtcgtgacaagactggaggaggaagcagctcgttttttcggaaaaccagccgcggagaagcaacaggctggacctgctagtccttttggatatggttgcaagaacattggctgccatggtgacacgggcgagctcgagtatcttctcctccacaccaatcttctctccgtctctgaaagatccaaaaccatctcgaacgacccttcaggattcagttgtgcggtgagtgattacataagagcagttaggcagcttgcatgtgagattcttgatcttgcggctgagggcttgtgggtcccggataaacatgtattcagtaggctcatcagagacgtccatagcgattcagttcttagacttaatcactatcctgcagtcgaagagatcgcagattgggacccatcacctataagaattggttttggtgagcactccgaccctcagatcttgaccatcttgcgatccaacgatgttgcgggcctccaaatttgcttgcatgatggtttgtgggtacccgtccctcctgactccacaggattctacgtgattgtgggtgattcctttcaggttttaaccaatgggagatttgaaagcgtgaggcatagggtattgacaaactcgagccagccaagaatgtcaatgatgtattttggggcaccaccccttactgcatggatcgctcctctctcacacatggtttcacagcaaaatccaagcctttataaacccttcacttggagtgaattcaagaaagctgcctactctctacgtttgagagatacgcgtcttgacctcttcaagattcacgccactgaaaaatctgcttcattgtaa

SEQ ID NO: 645 - protein, 332 aa, Populus trichocarpa
MVVPSPTPIRTKTTKALGIPTVDLSLDNSSVSQLIVRACEEYGFFKVINHGVNKEVVTRLEEEAARFFGKPAAEKQQAGPASPFGYGCKNIGCHGDTGELEYLLLHTNLLSVSERSKTISNDPSGFSCAVSDYIRAVRQLACEILDLAAEGLWVPDKHVFSRLIRDVHSDSVLRLNHYPAVEEIADWDPSPIRIGFGEHSDPQILTILRSNDVAGLQICLHDGLWVPVPPDSTGFYVIVGDSFQVLTNGRFESVRHRVLTNSSQPRMSMMYFGAPPLTAWIAPLSHMVSQQNPSLYKPFTWSEFKKAAYSLRLRDTRLDLFKIHATEKSASL

SEQ ID NO: 646 - DNA, 984 bp, Pisum sativum
atggtgttactatccaaaccaacttcagaacaatacacctatgttaggaacaacatgccaatcacattttcttcatcaatccctctcgttgacctatcaaaaccagatgcaaaaaccctcatagtaaaagcttgtgaagattttggattcttcaaagttataaaccatggtatccctttggatgctatctcccaattggaatccgaggccttcaaattcttctctctccctcaaacagagaaagaaaaagcagggcctgcaaatccttttggctatggtaacaaacgtattggactcaatggtgatattggttggattgaatatcttctcctcacaaccaatcaagatcacaatttctctctttatggagaagacatacacaaatttaggggtttgttgaaagattataagtgtgcaatgaggaatatggcatgtgagatacttgatttgatggcagaagggttaaagatacaaccaaagaatgtgtttagcaagcttgtgatggataaacagagtgactgtctttttagggttaatcattaccctgcttgccctgaattagctatcaatggtgagaatttgattggctttggagaacacactgaccctcaaattatttcaattttgaggtcaaataatacttcaggctttcaaatttctcttagagatggtagctggatttcagttcctcctgatcatagctccttctttatcaatgttggtgattctcttcaggttatgactaatgggaggttcaaaagtgtgagacatagagttttggcaaatggcatagacccaaggctgtctatgatttacttttgtggaccacctttgagtgagaaaatagcaccattaccttcactcatgaaaggaaaagaaagtttgtataaagaatttacatggtttgagtacaagagttcaacttatggttcaaggttggctgataataggcttggaaattatgaaaggattgctgccacttaa

SEQ ID NO: 647 - protein, 327 aa, Pisum sativum
MVLLSKPTSEQYTYVRNNMPITFSSSIPLVDLSKPDAKTLIVKACEDFGFFKVINHGIPLDAISQLESEAFKFFSLPQTEKEKAGPANPFGYGNKRIGLNGDIGWIEYLLLTTNQDHNFSLYGEDIHKFRGLLKDYKCAMRNMACEILDLMAEGLKIQPKNVFSKLVMDKQSDCLFRVNHYPACPELAINGENLIGFGEHTDPQIISILRSNNTSGFQISLRDGSWISVPPDHSSFFINVGDSLQVMTNGRFKSVRHRVLANGIDPRLSMIYFCGPPLSEKIAPLPSLMKGKESLYKEFTWFEYKSSTYGSRLADNRLGNYERIAAT

SEQ ID NO: 648 - DNA, 1038 bp, Pisum sativum
atggtagtgccttctccaacttccatgataagaacaaagaaaacaaaggcagtaggaattccgacgatcgacctttctctcgaaaggtcgcagttgtcggaattagtagtgaaagcatgtgaagaatatggtttcttcaaggtggtgaatcatagtgtaccaaaagaggttatttctagattggatgaggaaggaatagagtttttctcaaaaaattcttcagaaaaacgtcaagctggtacttctactccttttggttatggctgcaaaaatattggtcctaatggtgataaaggtgaacttgaatatcttcttcttcattccaatcctatttcaatctctgaaagatccaaaaccatagcaaaagatcaccccataaagttcagttgcatcgtcaatgattacataaaagcagttaaagacttaacatgtgagattcttgagctagcagcagaaggattgtgggtccctgacaagtcctcactcagcaaaattatcaaagatgaacatagtgactcacttcttagaatcaatcactaccctccagttaagaaactagggaatgataattgggacccatccaaaattcagaatagcaataataataatattggttttggagaacattctgaccctcagatcttaactatcttaagatccaacaacgtgggtggtcttcagatttcaactcaccatggtttgtggatccctgtccctcctgaccccagtgaattctatgtcatggttggtgatgcccttcaggttttgacaaatggaagatttgtgagtgtgagacatagagttttgacaaacacaacaaagcctagaatgtcaatgatgtattttgcagcaccaccgttgaattggttgataagcccgttatcgaagatggtgacggcccatagcccatgtttatataggccctttacatgggcccaatacaaacaagcagcatatgctctcagattaggagatacacgtcttgatcaattcaaggttcaaaaacaagaagatagcaatgattctcattctctatga

SEQ ID NO: 649 - protein, 345 aa, Pisum sativum
MVVPSPTSMIRTKKTKAVGIPTIDLSLERSQLSELVVKACEEYGFFKVVNHSVPKEVISRLDEEGIEFFSKNSSEKRQAGTSTPFGYGCKNIGPNGDKGELEYLLLHSNPISISERSKTIAKDHPIKFSCIVNDYIKAVKDLTCEILELAAEGLWVPDKSSLSKIIKDEHSDSLLRINHYPPVKKLGNDNWDPSKIQNSNNNNIGFGEHSDPQILTILRSNNVGGLQISTHHGLWIPVPPDPSEFYVMVGDALQVLTNGRFVSVRHRVLTNTTKPRMSMMYFAAPPLNWLISPLSKMVTAHSPCLYRPFTWAQYKQAAYALRLGDTRLDQFKVQKQEDSNDSHSL

SEQ ID NO: 650 - DNA, 1014 bp, Spinacia oleracea
atggtggtgttatctcatgttgcattagaccaattcatgaaaacctgcaaaccaatagacacacacttattccctacagtaatcccaaccattgacttaaactctcctgatgttaaatccctgattgttaaagcttgtaaggaattcgggttttttaaggtggttaaccatggcgtaccaattgagatgacgaggcaattagaagatgaagcaagtaaattctttagtttgcctcaaggacttaaagaaagtgctggaaatcctaacccctttggttatggtaacaagaagattggtcgtaatggtgacgtcggttggattgagtatcttctgttatctgcttctgatgagttcatctcacagacttgtctctccatttatccggataaccctgatgttttcaggtgtgctttaaacaattacatatcaaaaatgaagaaaatgggggtgagagtgttagaaacaatggcggaagggctgaatttgaaaggagaagacaggtatgcgttgagtaatctgataaaagatagcaaaagcgactcgtatttcaggctgaatcattatccaccaaggcctgaggcgtttgaaggcatcaacggtaggaacttggttggatttggagagcatacagacccacaaatcatatctgttcttcgatcaaataaaattggaggcctccaaatctctctcaatgatggaacttgggtctctgttccacctgatgataactcctttttcatactcgttggggactctttgcaggtgatgactaatggaagatttaagagtgtgaaacacagggttttggctgacaacatgaaatcaagattatcaatgatcttctttgcgggcccacctttatgtcaaaagatagcacctttaccttgcattatgcaaaaaggagaagaaagcttgtacgaagaattcacttggtgtgaatacaaaaaatcagcttacaaatctaggttgagtgagaataggctcttacgctttgtaaagagaaatcataactaa

SEQ ID NO: 651 - protein, 337 aa, Spinacia oleracea
MVVLSHVALDQFMKTCKPIDTHLFPTVIPTIDLNSPDVKSLIVKACKEFGFFKVVNHGVPIEMTRQLEDEASKFFSLPQGLKESAGNPNPFGYGNKKIGRNGDVGWIEYLLLSASDEFISQTCLSIYPDNPDVFRCALNNYISKMKKMGVRVLETMAEGLNLKGEDRYALSNLIKDSKSDSYFRLNHYPPRPEAFEGINGRNLVGFGEHTDPQIISVLRSNKIGGLQISLNDGTWVSVPPDDNSFFILVGDSLQVMTNGRFKSVKHRVLADNMKSRLSMIFFAGPPLCQKIAPLPCIMQKGEESLYEEFTWCEYKKSAYKSRLSENRLLRFVKRNHN

SEQ ID NO: 652 - DNA, 990 bp, Spinacia oleracea
atggtggtagcttctccaaaccctctaaaaagaagcaagaaaacaaaggccatgggagttccaaccattgatctttctcttaaatatcaacaacgttctaccttaaccgacctcattgttgaagcttgtgaagacttcggaatttttaaggttgttaatcatgggatttccacggaggttatttccgcccttgaaaaccacggcctcgacttcttctcgaagccgacgccggaaaaacaccttgtcgtgggccccactgtccccaaaccctttggctatggcttccgtaacattggcaacaatggtgacgtgggtgatcttgaataccttctccttcacgctaacctctcttccacccatccacctcttttcggtgaggcggtggatgattacgtgggggcagtagcagatttatcatgtgaactcttagatctgatggctgagggtttgtgggtctctgataaaacgatctttagcaagttaatcagagacgttcaaagtgactctcttctcagattaaatcactaccctccattaaaaaacaaggattcattcatcaacggttctggagagcgtattggatttggggagcattctgaccctcagatcttaaccatcttgagatccaacgatgttggaggcctccagatttgtatgcctgatggcttgtgggtccctgttcaaccagatcctaatgccttctatgttatggtgggagatgctcttcaggtattaacaaatggaagattcggaagtgtgaaacacagggcaatggcaaacaattcaacaaccaaagcaagaatgtcaatgaacttttttggagcgccacctttgaacgccacaatttctccgatacaagaaatggtgtcacctatgaatccaaacctatataagccatttacatggggagaatataagagagcaatgcattcttcaaggctaagtgattgtcgtctaaacctattcaagagacgtattaatgaccaatga

SEQ ID NO: 653 - protein, 329 aa, Spinacia oleracea
MVVASPNPLKRSKKTKAMGVPTIDLSLKYQQRSTLTDLIVEACEDFGIFKVVNHGISTEVISALENHGLDFFSKPTPEKHLVVGPTVPKPFGYGFRNIGNNGDVGDLEYLLLHANLSSTHPPLFGEAVDDYVGAVADLSCELLDLMAEGLWVSDKTIFSKLIRDVQSDSLLRLNHYPPLKNKDSFINGSGERIGFGEHSDPQILTILRSNDVGGLQICMPDGLWVPVQPDPNAFYVMVGDALQVLTNGRFGSVKHRAMANNSTTKARMSMNFFGAPPLNATISPIQEMVSPMNPNLYKPFTWGEYKRAMHSSRLSDCRLNLFKRRINDQ

SEQ ID NO: 654 - DNA, 1128 bp, Spinacia oleracea
atggcttctaccaaggtagtggagcacctcaaggaaaatgtactttggaagcaagcaattatggaccgtaatgcaaacatatcagaccctccatttgaagagacatacaaaaacctcctcctaaaacacaatattacacccctcaccaccaccaccaccaccaccaccaccaccgcgaccatcgaagtccgtgacttacccctaatcgacttgtcccggctagtggctaccgcggccaaagagcgagaaaactgcaaaagagacatcgcgaacgcctcgagagagtgggggttcttccaagtggtgaaccacggcataccgcaccgtatgttagaggaaatgaacaaggaacaagtgaaagtgtttagggagccattcaacaagaaaaaaggggataattgtatgaatttaaggctatctcctggaagttaccgttggggttctcctacacctaattgtttatcacaattatcttggtctgaagcttttcacattcctatgaatgatatttgcagcaatgctcctaggaatattgccaatggaaatcctaatatcagcaatctatgctcaacggtgaaacaatttgccaccacagtatctgaactagccaataaattggcaaacatattggtggaaaaattggggcatgatgagctgacctttattgaggaaaaatgttcaccaaatacatgttatctaaggatgaatagatacccaccatgccctaaatattcccatgttcttggattgatgccacacacagacagtgacttcctcacaattttataccaagatcaagttggtggattgcagcttgttaaagatggaagatggatatcggttaagcctaatcccgaggctcttattgttaatattggggatctgtttcaggcttggagcaatggtgtgtataagagtgtggtgcatcgagttgttgcgaatccaaggtttgagagattttcaacagcgtactttttgtgtccatcaggtgatgctgttatacaaagttacagggagccttcaatgtataggaagtttagctttggagagtacagacaacaagttcaacaagatgttagagaatttggtcacaagattggactttcacgcttcctcatttgcaactag

SEQ ID NO: 655 - protein, 375 aa, Spinacia oleracea
MASTKVVEHLKENVLWKQAIMDRNANISDPPFEETYKNLLLKHNITPLTTTTTTTTTTATIEVRDLPLIDLSRLVATAAKERENCKRDIANASREWGFFQVVNHGIPHRMLEEMNKEQVKVFREPFNKKKGDNCMNLRLSPGSYRWGSPTPNCLSQLSWSEAFHIPMNDICSNAPRNIANGNPNISNLCSTVKQFATTVSELANKLANILVEKLGHDELTFIEEKCSPNTCYLRMNRYPPCPKYSHVLGLMPHTDSDFLTILYQDQVGGLQLVKDGRWISVKPNPEALIVNIGDLFQAWSNGVYKSVVHRVVANPRFERFSTAYFLCPSGDAVIQSYREPSMYRKFSFGEYRQQVQQDVREFGHKIGLSRFLICN

SEQ ID NO: 656 - DNA, 726 bp, Rice tungro bacilliform virus; identical to SEQ ID NO: 39

SEQ ID NO: 657 - DNA, 165 bp, Rice tungro bacilliform virus; identical to SEQ ID NO: 40

SEQ ID NO: 658 - DNA, 2000 bp, Zea mays; identical to SEQ ID NO: 41

SEQ ID NO: 659 - DNA, 2000 bp, Oryza sativa; identical to SEQ ID NO: 42

SEQ ID NO: 660 - DNA, 2000 bp, Oryza sativa; identical to SEQ ID NO: 43

SEQ ID NO: 661 - DNA, 2000 bp, Oryza sativa; identical to SEQ ID NO: 44

SEQ ID NO: 662 - DNA, 2000 bp, Oryza sativa; identical to SEQ ID NO: 45

SEQ ID NO: 663 - DNA, 786 bp, Zea mays; identical to SEQ ID NO: 46

SEQ ID NO: 664 - DNA, 1160 bp, Zea mays; identical to SEQ ID NO: 47

SEQ ID NO: 665 - DNA, 1532 bp, Oryza sativa; identical to SEQ ID NO: 48

SEQ ID NO: 666 - DNA, 841 bp, Oryza sativa; identical to SEQ ID NO: 49

SEQ ID NO: 667 - DNA, 1392 bp, Oryza sativa; identical to SEQ ID NO: 50

SEQ ID NO: 668 - DNA, 743 bp, Oryza sativa; identical to SEQ ID NO: 51

SEQ ID NO: 669 - DNA, 144 bp, Oryza sativa; identical to SEQ ID NO: 52

SEQ ID NO: 670 - DNA, 612 bp, Cauliflower mosaic virus; identical to SEQ ID NO: 53

SEQ ID NO: 671 - DNA, 837 bp, Coix lacryma-jobi; identical to SEQ ID NO: 54

SEQ ID NO: 672 - DNA, 947 bp, Oryza sativa; identical to SEQ ID NO: 55

SEQ ID NO: 673 - DNA, 721 bp, Mirabilis mosaic virus; identical to SEQ ID NO: 56

SEQ ID NO: 674 - DNA, 352 bp, Peanut chlorotic streak virus; identical to SEQ ID NO: 57

The invention claimed is:

1. A method comprising:

(a) fertilizing a plurality of female inbred corn plants with pollen from at least one male inbred corn plant to produce hybrid corn seeds, wherein the plurality of female inbred corn plants have an average height that is at least 2.5% lower than the average height of the at least one male inbred corn plant, and wherein the plurality of female inbred corn plants comprise a mutant allele of an endogenous Brachytic2 (br2) locus that comprises a premature stop codon within a nucleic acid sequence encoding a Brachytic2 protein as compared to a nucleotide sequence encoding a wild-type Brachytic2 protein that comprises a sequence having at least 95% identity to SEQ ID NO: 132 or SEQ ID NO: 180; and (b) harvesting said hybrid corn seeds from one or more of the plurality of female inbred corn plants.

2. The method of claim 1, wherein the premature stop codon is positioned within a region of a br2 mRNA transcript selected from the group consisting of the first exon, the second exon, the third exon, the fourth exon, and the fifth exon.

3. The method of claim 1, wherein the premature stop codon is introduced into the coding sequence of an endogenous br2 gene via a targeted editing technique and/or site-directed integration.

4. The method of claim 1, wherein the premature stop codon results in a mutant allele that encodes an mRNA transcript comprising a premature stop codon as compared to SEQ ID NO: 180.

5. The method of claim 1, wherein the mutant allele of the endogenous br2 locus suppresses the expression of a wild-type allele of the endogenous br2 locus.

6. The method claim 1, wherein the mutant allele comprises a deletion of (A) at least one nucleotide of at least one exon of the endogenous br2 locus as compared to SEQ ID NO: 132; and/or (B) a deletion of at least one nucleotide from at least one intron of the endogenous br2 locus.

7. The method of claim 1, wherein the mutant allele of the endogenous br2 locus encodes a truncated protein as compared to SEQ ID NO: 181.

8. The method of claim 1, wherein the plurality of female inbred corn plants have improved lodging resistance relative to an unmodified control plant.

9. The method of claim 1 further comprising:

planting the at least one male inbred corn plant in proximity to the plurality of female inbred corn plants.

10. The method of claim 1, wherein the plurality of female inbred corn plants do not have any significant off-types in at least one female organ or ear.

11. The method of claim 1, wherein the yield or seed yield of the hybrid corn seeds produced in step (b) is greater than the yield or seed yield of control hybrid corn seeds obtained from fertilizing a plurality of control female inbred corn plants with pollen from at least one control male inbred corn plant and harvesting said control hybrid corn seeds from one or more of said control female inbred corn plants, wherein said control hybrid corn seeds are harvested from the same number of female inbred corn plants as in step (b), and wherein the average height of said plurality of control female inbred corn plants is the same or similar to the average height of said at least one control male inbred corn plants.

12. The method of claim 11, wherein the yield and/or seed yield is increased by at least 3.0%, relative to the yield of hybrid corn seeds obtained from fertilizing a plurality of control female inbred corn plants with pollen from at least one control male inbred corn plant, wherein the female and male control plants do not differ in average height.

13. The method of claim 11, wherein said female inbred corn plants and said at least one male inbred corn plant are grown in (A) a corn field; or (B) a greenhouse.

14. The method of claim 13, wherein the corn field comprises at least one row of female inbred corn plants and at least one row of male inbred corn plants.

15. The method of claim 14, wherein the corn field comprises at least 1 female row for every male row.

16. The method of claim 13, wherein the corn field comprises a planting density of at least 12,000 corn plants per acre.

17. The method of claim 1, wherein harvesting said hybrid corn seeds from one or more of the plurality of female inbred corn plants comprises harvesting with consistent production stability.

18. The method of claim 1, wherein the yield or seed yield harvested in step (b) is less variable as compared to a yield or seed yield of control hybrid corn seeds that are harvested from control female inbred corn plants that have a same or similar average height as control male inbred corn plants.

* * * * *